United States Patent 7,745,391 (HUMAN THROMBOSPONDIN POLYPEPTIDE) - sequence listing, part 164

SEQ ID NO: 421572 - DNA, 4136 bp, Homo sapiens
ggccgctcgcgcttttctctccttctccaagatggcggcgatcggcggcgttgaggcgggatccgggcgagccgagtgaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggaggacagtggttcttgttctgagtgccgataaaccagtgtgaaggaggagagaggtggagggctggtattttggaggattcagcatagaagaacagtctgcatttgtgatacaccagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtgtctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttacggaggtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgtaaaccagtct

SEQ ID NO: 421573 - DNA, 4181 bp, Homo sapiens
ggccgctcgcgcttttctctccttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggaggacagtggttcttgttctgagtgccgataaaccagtgtgaaggaggagagaggtggagggctggtattttggaggattcagcatagaagaacagtctgcatttgtgatacaccagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtgtctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgatttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgtaaaccagtct

SEQ ID NO: 421574 - DNA, 4021 bp, Homo sapiens
ggccgctcgcgcttttctctccttctccaagatggcggcgatcggcggcgttgaggcgggatccgggcgagccgagtgaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtgtctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttacggaggtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgtaaaccagtct

SEQ ID NO: 421575 - DNA, 4120 bp, Homo sapiens
ggccgctcgcgcttttctctccttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtgtctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttacggaggtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgtaaaccagtct

SEQ ID NO: 421576 - DNA, 2804 bp, Homo sapiens
ggccgctcgcgcttttctctccttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggaggacagtggttcttgttctgagtgccgataaaccagtgtgaaggaggagagaggtggagggctggtattttggaggattcagcatagaagaacagtctgcatttgtgatacaccagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtgtctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgatttcattccaattcctactgtataggtgtctgtgtctcaaaatttattgtaatcattggtaccattggtggcctcaacagaggccaaggagttctgtgagccctggcagcaaaaaacaccttggggggtgaagctgtctatttcatatctccgatgctcattccactctgagctacgtcaccacctttttatgactctcttcacatgccgtcgtcttttactcg

SEQ ID NO: 421577 - DNA, 2847 bp, Homo sapiens
ctcagctcgctacctgttacatgtagcatagtgacgaacacaagaacaagaagacaaggaccacgcagtagagagagcatccgagaaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttacggaggtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgtaaaccagtct

SEQ ID NO: 421578 - DNA, 906 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgaggtacgttcgttgtccgacgtccacctcgggacttcttcggcatcttaatgtccaagcctgtgcggagagccaagttgttctaggggctttcattgccacaagaaacatatttttcgtttttcgttgcaaaacctttaagtgcaattattgcgcttaatgaactcagtcattagagatagtaattcagtgtgattttaactttcctttgaaagactactttagcctgttgaattgtagcattttgtttctaagagactcgtacgaaatggaatatggcacacccacccggagctgtgtccgttaggtagaactgtactctcgcaatatctccaactaaacctcttttgtccgaattgttcaactcatggccccctgaacgtgaagcgctccttccccactgatctcgacctctgtccccacaacctcttgtctc

SEQ ID NO: 421579 - DNA, 498 bp, Homo sapiens
  misc_feature (5)..(5): n is a, c, g, or t
  misc_feature (37)..(37): n is a, c, g, or t
  misc_feature (39)..(39): n is a, c, g, or t
  misc_feature (41)..(41): n is a, c, g, or t
  misc_feature (49)..(49): n is a, c, g, or t
  misc_feature (56)..(56): n is a, c, g, or t
  misc_feature (102)..(102): n is a, c, g, or t
  misc_feature (115)..(115): n is a, c, g, or t
  misc_feature (117)..(117): n is a, c, g, or t
  misc_feature (131)..(131): n is a, c, g, or t
  misc_feature (231)..(237): n is a, c, g, or t
  misc_feature (259)..(259): n is a, c, g, or t
  misc_feature (265)..(265): n is a, c, g, or t
  misc_feature (299)..(299): n is a, c, g, or t
  misc_feature (378)..(378): n is a, c, g, or t
  misc_feature (478)..(478): n is a, c, g, or t
  misc_feature (487)..(487): n is a, c, g, or t
tacancttgtaagacccagctactcgggagcccgagncnangaggattnctttgancctgcccagggagcgttgagcccacagtgggctatgattgggaatnccggccttggagncncatctatgtcaacncacttacggttattagtaatgttcatcatgtctgctggaacagctatagcatcatatttcattccaagcactgttggtgtggttcttttcatgactggannnnnnnggatactttcctaacccagagnggccanaggagcacaggacgcccaggccgagggcagtgangcttgcagacccaggctgtgcaacccccacagcaggtctcctcacgggatagatagactattggccccaattcctcagncctacatatgcacccaccccttgccatggtttcgttgtgggttggagggtacttttcccagcccctggctttgggctttgcccacgtgtcttgctctggncatggaatnaagcaacaaat

SEQ ID NO: 421580 - DNA, 3897 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaa

SEQ ID NO: 421581 - DNA, 2190 bp, Homo sapiens
caagacagacactcgggtaaacagatcagtgcaaacaagattgcggcataagccatttcggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaa

SEQ ID NO: 421582 - DNA, 4211 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgtatttatgactatgcatcgctgaggcaacagatcagaaaaggcagacaaagagaagtgactaagattttgcctaatggtgattgagatggctgccaggaaacttttatttaaagaaccaaggaagtagaggtaattcttgattctgaatacaggcaacttgtgtacatttttaaacactactttctgttttttgaacttgggaaaagtttgcctaattacaatgcaatttttctctaagtttatgaataaaatataaagacctaaatggaatctcttttctttttctcctcctcctaccctttttactttaaagggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaa

SEQ ID NO: 421583 - DNA, 2956 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaa

SEQ ID NO: 421584 - DNA, 1401 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgagaaactgctgtgttacagaaaagcatgtgactttcagaataatcccgagtgaggatgagtccagatgtgcctctactgaatgattacaagcaggacttctttctgaagcccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaa

SEQ ID NO: 421585 - DNA, 1523 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgagaaactgctgtgttacagaaaagcatgtgactttcagaataatcccgagtgaggatgagtccagatgtgcctctactgaatgattacaagcaggacttctttctgaagcgctttccacagactgttcttggaggccctcgattcaaattaggctattgtgcccctccttacatatatgttaatcaaattattctttttctaatgccatgggtttggggtggagtcggaacacttttgtaccagttaggcatcctgaaagactattatacagcagcactttcaggtggattaatgctttttactgcatttgtcatccagttcacaagtttatacgccaaaaacaaatcaacaacagtagaaagaatactaaccacggatatcttagcagaggaggatgagcatgaatttaccagttgtactggtgctgagactgtcaaatttctcattcctggcaagaaatatgtagccaatacagtttttcattctattcttgctggattagcgtgtggtcttggaacatggtatctgctcccaaatagaataaccttgctgtatggcagtacaggaggcactgctctactattcttctttggatggatgacactatgtatagcagaatattctttaattgtaaacacagctacagagactgcgactttccaaacacaggatacttatgaaattattcctcttatgagacctctttatatttttttctttgtttctgtggatctggcacacaggtaaaaacctaccaaatactttgtaactaactttgtttttaagtatacagagtaagagagctttccttttagtgttacaaaaaaatgaatccatggattaaaaatcatcaaaccattgggtgacagactgagactctgtctcaaaaaagaaaatgaaagaaaaggacaaagtaacaggaagaaaagaaaaccgtcatgtcaaagagctaatgcccttcatatatgaaaagttcttccaaattcgtaagaaaaatgttcaaaaatgatcacttcaatagaaaaataggcaaaggacatgagccaattta

SEQ ID NO: 421586 - DNA, 382 bp, Homo sapiens
gtttgttttcatagacttcaattcataaactttaaaaaacttttaataaaatattttccttccttttcaaaaaatatccttctaatatatgtgaaaggagcggggttcatcccattcatcatgtgaatattcacaggaagagcaatgttagggtaatctgcatatgactactaaagcatatatctgactcattatgtatttctttcaactgaatttactgcttctgaaaaatgatttacccaacaggactaccagttactagtgtcttaaggtatatgaactaaagtcagaaggagatggaagaaaatttttataatacgatctgaattttattttcattctcttcttgcttaggaacgttttacagatacatgtaaggggg

SEQ ID NO: 421587 - DNA, 663 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgaggtacgttcgttgtccgacgtccacctcgggacttcttcggcatcttaatgtccaagcctgtgcggagagccaagttgttctaggggctttcattgccacaagaaacaaaatgctacaattcaacaggctaaagtagtctttcaaaggaaagttaaaatcacactgaattactatctctaatgactgagtt

SEQ ID NO: 421588 - DNA, 3651 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactgagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaa

SEQ ID NO: 421589 - DNA, 4027 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgtatttatgactatgcatcgctgaggcaacagatcagaaaaggcagacaaagagaagtgactaagattttgcctaatggtgattgagatggctgccaggaaacttttatttaaagaaccaaggaagtagagggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaa

SEQ ID NO: 421590 - DNA, 3359 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaa

SEQ ID NO: 421591 - DNA, 1553 bp, Homo sapiens
cgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggatcgcccagcccgggtttacctgcaaaaatgcggtccctgggatgccttcgcgtcttctcttccctcgggtgacttgagaaactgctgtgttacagaaaagcatgtgactttcagaataatcccgagtgaggatgagtccagatgtgcctctactgaatgattacaagcaggacttctttctgaagcgctttccacagactgttcttggaggccctcgattcaaattaggctattgtgcccctccttacatatatgttaatcaaattattctttttctaatgccatgggtttggggtggagtcggaacacttttgtaccagttaggcatcctgaaagactattatacagcagcactttcaggtggattaatgctttttactgcatttgtcatccagttcacaagtttatacgccaaaaacaaatcaacaacagtagaaagaatactaaccacggatatcttagcagaggaggatgagcatgaatttaccagttgtactggtgctgagactgtcaaatttctcattcctggcaagaaatatgtagccaatacagtttttcattctattcttgctggattagcgtgtggtcttggaacatggtatctgctcccaaatagaataaccttgctgtatggcagtacaggaggcactgctctactattcttctttggatggatgacactatgtatagcagaatattctttaattgtaaacacagctacagagactgcgactttccaaacacaggatacttatgaaattattcctcttatgagacctctttatatttttttctttgtttctgtggatctggcacacaggtaaaaacctaccaaatactttgtaactaactttgtttttaagtatacagagtaagagagctttccttttagtgttacaaaaaaatgaatccatggattaaaaatcatcaaaccattgggtgacaggttattttgataattattcttttaggattaatctctgtaaaacatactaaagcaatagttaaaacttactaaagagtttttttaaaaaaccctttttgagataaggaacttttcaattttgtgtttcactttaaataaggagctttgagtttttaagatagcctggctaaaacctgtgtaaggagatggaactttcctgtggggggaaagaa

SEQ ID NO: 421592 - DNA, 409 bp, Homo sapiens
aggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttaggtaggaagataaagtctattaaccttgtgttacaaatcatatcctggaagtattcaaaaatattactcaattcccatatttgtgtggtattataccatatacaagtgtttgttcttttatgttatggttttttgtttattggctttttagttcatcgcttaaatgtgctcataaaaaatgtgtatttgccagaataaaatatggtagaaggagc

SEQ ID NO: 421593 - DNA, 1032 bp, Homo sapiens
ctgggccacagagcgagactccgtctcaaaaaataaaataaatcataatgttgacctcaaagaggaagcctaccgttgagtttagtaagatctttgctacacacaatgtgatgctggcagtggcaggggcagtaatctttatttcgtcatttttgaaacatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaacaaaaaacatttaatccttgccttttgtgctggggttctactgacactgctgctgatagcctttatcttcctcatcataaagagctacagaaaatatcactccaagccccaggccccagatcctcactcagatcctccagccaagctttcatccatcccaggggaatcacttacctatgccagcacaactttcaaactctcagaagaaaagagcaatcacttggctgagaaccattctgcagactttgaccccattgtctatgctcaaattaaagtaacaaactaactcagcttttccaatgaggcttgaatccatttcctctcatctcagccctatcttcacacatcactttcacttttttacaaattttggaccaccacctgtgtgaaactgcagtcggagttgtttagatgtgatctggcaatgctatccagcatctttggagaccaatggtcagtcttttcctggccagaggaaagattgatggccctcccacttgaactgacagcctgtgagccccttgggggcatagactgccttccttggacccttccaaagtgtgtggtacagagctcagtgcacagagtattcacccagcatcatgaatcaacttgggaggagtcaaccaaatgaacaatctaccaaaaatttcaaataaagtcaaaccccccaca

SEQ ID NO: 421594 - DNA, 978 bp, Homo sapiens
ctgggccacagagcgagactccgtctcaaaaaataaaataaatcataatgttgacctcaaagaggaagcctaccgttgagtttagtaagatctttgctacacacaatgtgatgctggcagtggcaggggcagtaatctttatttcgtcatttttgaaacatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaacaaaaaacatttaatccttgccttttgtgctggggttctactgacactgctgctgatagcctttatcttcctcatcataaagagctacagaaaatatcactccaagccccaggccccagatcctcactcagatcctccagccaagctttcatccatcccaggggaatcacttacctatgccagcacaactttcaaactctcagaagatgctcaaattaaagtaacaaactaactcagcttttccaatgaggcttgaatccatttcctctcatctcagccctatcttcacacatcactttcacttttttacaaattttggaccaccacctgtgtgaaactgcagtcggagttgtttagatgtgatctggcaatgctatccagcatctttggagaccaatggtcagtcttttcctggccagaggaaagattgatggccctcccacttgaactgacagcctgtgagccccttgggggcatagactgccttccttggacccttccaaagtgtgtggtacagagctcagtgcacagagtattcacccagcatcatgaatcaacttgggaggagtcaaccaaatgaacaatctaccaaaaatttcaaataaagtcaaaccccccaca

SEQ ID NO: 421595 - DNA, 603 bp, Homo sapiens
ctgggccacagagcgagactccgtctcaaaaaataaaataaatcataatgttgacctcaaagaggaagcctaccgttgagtttagtaagatctttgctacacacaatgtgatgctggcagtggcaggggcagtaatctttatttcgtcatttttgaaacatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaagtaaatgagcattctcctatctgtttcatcttgtaccacgtgggatttgatgttgtgctgacagcctcggcttggggatttgggcagggagactggggagaaaggactagaaacagtaaaagaacaaagtcagtttgtgatctcaggagtatggctcttaatttggcatcccctaagcttcaagagatccatggatcccctaagcttataggtaaaatttgctgggtggggaattatgaacattgt

SEQ ID NO: 421596 - DNA, 287 bp, Homo sapiens
atcgaagggagaggcttcccatttccccaggcccattgctgagatgggtccctcttctttctggcaccatggcagatcactccaagccccaggccccagatcctcactcagatcctccagccaaggtaagatgaccacactgttttggggacactgaagggctaccgtcattggaattcccctccatactcttcattatctgctagaatggtggtattgatttccagacactgggcaagtgattctttgaccaaagtgctcaggttgcttctaaagagcaacctttt

SEQ ID NO: 421597 - DNA, 1107 bp, Homo sapiens
ctgggccacagagcgagactccgtctcaaaaaataaaataaatcataatgttgacctcaaagaggaagcctaccgttgagtttagtaagatctttgctacacacaatgtgatgctggcagtggcaggggcagtaatctttatttcgtcatttttgaaacatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaacaaaaaacatttaatccttgccttttgtgctggggttctactgacactgctgctgatagcctttatcttcctcatcataaagagctacagaaaatatcgaagggagaggcttcccatttccccaggcccattgctgagatgggtccctcttctttctggcaccatggcagatcactccaagccccaggccccagatcctcactcagatcctccagccaagctttcatccatcccaggggaatcacttacctatgccagcacaactttcaaactctcagaagaaaagagcaatcacttggctgagaaccattctgcagactttgaccccattgtctatgctcaaattaaagtaacaaactaactcagcttttccaatgaggcttgaatccatttcctctcatctcagccctatcttcacacatcactttcacttttttacaaattttggaccaccacctgtgtgaaactgcagtcggagttgtttagatgtgatctggcaatgctatccagcatctttggagaccaatggtcagtcttttcctggccagaggaaagattgatggccctcccacttgaactgacagcctgtgagccccttgggggcatagactgccttccttggacccttccaaagtgtgtggtacagagctcagtgcacagagtattcacccagcatcatgaatcaacttgggaggagtcaaccaaatgaacaatctaccaaaaatttcaaataaagtcaaaccccccaca

SEQ ID NO: 421598 - DNA, 3139 bp, Homo sapiens
ggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcagattttgaggatgacatgattataacatctgatgtctctcgatatattgaagaccctggttttgggtatgaagactttgccagacgaggagaagagcatttgccaacattccgagctcaggactatacctgggaaaatcatgggttctccctggtgaacagactttattctgacattggacatcttcttgatgaaaagtttcggatggtctacaatctcacatataacactatggccacccatgaggatgttgacacaaccatgctgcgcagagctttatttaactatgttcactgtatgtttggaatcaggtatgatgactatgattatggagaagttaatcaattacttgaaagaagcctgaaggtttacattaagacagtgacctgctatcctgagagaactacaaaacgcatgtatgatagttactggcggcagttcaaacactcagaaaaagttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtcaaagtttagccgtttgtttttttttttttgttttttgcggctgtaatgtgcaatgatgtgttttattttccttgatgcttaacattactaacaattgcaaaaataatactgaggagcactactttgcattgtttgtagttggagttttggatactgatcataaatcatgaatctggcgtattaatgcttaacttcagcgcttttgggttgtgtgtatgtgtattttttctccccccaccccgcccttttttttttaagaataaggacaagtgcttacaatctgctcaagcaattgtttttcagatattggaattcagcaaagagtgacctctctggccattctaaaactttaatgttgtgtcctaaatctggtggaggaaaagcatgcgctgttgaaccaagctgctcactggacacatatttgtgtccccaggagattatttgtcaggcactgttttttatttgtttgtttgttcatttattgttgttttactgctattggcgataacatgaaatgtgatacagctattgcccataatttaatgtgaaattaatcatgatgaattctatagcatgctactgaaatgccaaattcagctattttctttctcttctaaaatggaagtttcagttttccatatcagatgtatataagtggaattataacacaatcctatcactgacagtaatcctcagtcaccttaaataatcagtgctcacagtgctgcttacagttcatttagttggcacatataaacctgtacccacacaagactgaccaaaaattttctttgcacatttttcctttctcatagtttttttctatatttcgttaagcaaaggaaggttaatatgcctatttttcctgttaggcttttagaaattattttccatgacttttgttcttataataggttagacagtttatttttcaaaggtaaaaattgtgtttctatgcattaatgtgattgaactacaaaaacagagtgcaatatgttcaaaaaatactcaactaaactttccccctgtcatatcactgcaaaagtgtccttttaaacagagccataaagaaatttttttcaaatttctttattgcacaggcttttttcagttttacctttctgggattgaacaatgttcctttcataatgccaaagcattcccttccccagaaaaatctccttggacaactggtttaaaaacgttattaagtcataggggaggaataagcggccaaaaagtcacatttttgcattggtttacgttgcttgattagactatcttcagagagcacattatgtgtttatagctttaatttgtattatgtcaatgaaccagtgaagtgcctaaagagatgcttacaactatccagtaggacacaactgcactgctttttaaacactttttggttagttaagggtgacttgaattgtacacatacatgctaatttttgaaaacttatccatttttcatagtaaataatatagataaaattttctgttagagttcccgcaaatatttcattttagacttacttgtgatataagatttaacttttcttttgtgaaagaatcgtgaactagtgtttcatgaaatcattttcctcttccatttatcatcctcctctggtacaatatattgggttgctttcttttagattttgttccagataggaaaacaaatatgactgtatacttattaacataaggtagttctgcatttttggattccaggatcctgtttgaaatcttccatgtgaggaaaaaattactaatatttttaaagacagggtggtttatttaaagagattattcagagaacttgtgccatatctcgtctgttttattgcatatgccatatgttaacttttattcaatattacattatgtagatatgtaatacaaagaaaatatttaggagaatggcaaaacacaaatggcaacataaatgtccatttgacttacctaacttcacaactttcaagttgaggatgtcatttattcttgaatttgtttttttactagatgctttcaattaatagccctatatttttgtgcaggcgaactgtataacaggataaaaaatgatttgtatgtattgaaaaggaggagaaattctcacagaacaccatatgagctttagaccaaaaggggaaacaag

SEQ ID NO: 421599 - DNA, 1224 bp, Homo sapiens
ggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcagattttgaggatgacatgattataacatctgatgtctctcgatatattgaagaccctggttttgggtatgaagactttgccagacgaggagaagagcatttgccaacattccgagctcaggactatacctgggaaaatcatgggttctccctggtgaacagactttattctgacattggacatcttcttgatgaaaagtttcggatggtctacaatctcacatataacactatggccacccatgaggatgttgacacaaccatgctgcgcagagctttatttaactatgttcactgtatgtttggaatcaggtatgatgactatgattatggagaagttaatcaattacttgaaagaagcctgaaggtttacattaagacagtgacctgctatcctgagagaactacaaaacgcatgtatgatagttactggcggcagttcaaacactcagaaaaagttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtcaaagtttagccgtttgtttttttttttttgttttttgcggctgtaatgtgcaatgatgtgttttattttccttgatgcttaacattactaacaattgcaaaaataatactgaggagcactactttgcattgtttgtagttggagttttggatactgatcataaatcatgaatctggcgtattaatgcttaacttcagcgcttttgggttgtgtgtattaataaaatatttgctaagaaaaaaaaaa

SEQ ID NO: 421600 - DNA, 398 bp, Homo sapiens
gggttatttttactgcttgcagagccattagacacaggtttgagtgttgcatcatgaacatggataaatatgcctaggtgtgtgtgtgtgtgtatattgcttatatacacataaaaaaacctttgtgaatgtctaataagattttccaggtgtttataatggttactaaactgataacattttcacttctaggttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtcaaagtttagccg

SEQ ID NO: 421601 - DNA, 5817 bp, Homo sapiens
agcaatatttaggggaggctgaggaggcctggggacagttttgggagagaaagagaatggtcgttgtggggctggggtaaatggggagaagaaagggtaggtctgcgctgagccggagtagtttggaaagggtgaatcagggagaggttaaagtgattggaaggggagcgagggagggcggtggggggcaggcttggggtactggggggggggcagagaccttagttgcgggatcccgcgctcagcgtcgcccctcgcgcccctagcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcattatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgtttttttttctccttacaaatatgatactctttagtgttaagctaaggcattgattcatgtatctgtccttataatgaattaataaactattttccagaaaaaaaaaaaaaaaaaaaaaaaaaaaaggggggggcgcgcccttatagagagatttctcccctgcggggggccccccaggcctttatccgcggtctacccccgcgtcttttcttgtgtgtgtcacaaggggggggctccctctattaggggagagccctgtgtgtatttatattttatcgcgccactatgtggcgccgcgcgtggtgcgccgccgcgcgccgggggtcttttctcctccacaccaccgcgctgtcgcggtgcgccaccgtgtg

SEQ ID NO: 421602 - DNA, 5783 bp, Homo sapiens
agcaatatttaggggaggctgaggaggcctggggacagttttgggagagaaagagaatggtcgttgtggggctggggtaaatggggagaagaaagggtaggtctgcgctgagccggagtagtttggaaagggtgaatcagggagaggttaaagtgattggaaggggagcgagggagggcggtggggggcaggcttggggtactggggggggggcagagaccttagttgcgggatcccgcgctcagcgtcgcccctcgcgcccctagcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcattatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgtttttttttctccttacaaatatgatactctttagtgttaagctaaggcattgattcatgtatctgtccttataatgaattaataaactattttccagaaaaaaaaaaaaaaaaaaaaaaaaaaaaggggggggcgcgcccttatagagagatttctcccctgcggggggccccccaggcctttatccgcggtctacccccgcgtcttttcttgtgtgtgtcacaaggggggggctccctctattaggggagagccctgtgtgtatttatattttatcgcgccactatgtggcgccgcgcgtggtgcgccgccgcgcgccgggggtcttttctcctccacaccaccgcgctgtcgcggtgcgccaccgtgtg

SEQ ID NO: 421603 - DNA, 5677 bp, Homo sapiens
agcaatatttaggggaggctgaggaggcctggggacagttttgggagagaaagagaatggtcgttgtggggctggggtaaatggggagaagaaagggtaggtctgcgctgagccggagtagtttggaaagggtgaatcagggagaggttaaagtgattggaaggggagcgagggagggcggtggggggcaggcttggggtactggggggggggcagagaccttagttgcgggatcccgcgctcagcgtcgcccctcgcgcccctagcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggcttctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgtttttttttctccttacaaatatgatactctttagtgttaagctaaggcattgattcatgtatctgtccttataatgaattaataaactattttccagaaaaaaaaaaaaaaaaaaaaaaaaaaaaaaacacaaaaaaacaaaaaacacagaaaaaaaaaaacctttttcggggcactctcgagccccacgaaaaagttttatgacaaaccacctcgtgggcgccgcgggggcaccatatggagtagataaaccacgtggccacacacggtctccacacagggaaacccggaggacaacaagaggggtgggaaccaccacaagataaaaaaagagggcgggggggaacacacagaggtgtgtgaaaaacacccccacggaggatacagagagacaagagggggacatacacagcgggcgatccaaagaggaaagcaatacaaaaaaagccgg

SEQ ID NO: 421604 - DNA, 2070 bp, Homo sapiens
cccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttttagagaggaaaaaacctgtattttcctggtgggatgaaatagggatgaaatggctcagaatggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgttggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctctcgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgtttttttttttttttgctgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaaaaaaaaaaaaag

SEQ ID NO: 421605 - DNA, 1992 bp, Homo sapiens
cccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgttggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctctcgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgtttttttttttttttgctgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaaaaaaaaaaaaag

SEQ ID NO: 421606 - DNA, 1429 bp, Homo sapiens
aaagacacagcacacacatgcacacgcagcaaagcgcagcgtgttggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctctcgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgtttttttttttttttgctgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaaaaaaaaaaaaag

SEQ ID NO: 421607 - DNA, 1225 bp, Homo sapiens
ggagacatgatagaatcgagctcggtaccgtaatgtctcgagtcgtgaggagacgagctctcgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgtttttttttttttttgctgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaaaaaaaaaaaaag

SEQ ID NO: 421608 - DNA, 1041 bp, Homo sapiens
ccacgcgtcgcggacgcgtgggctcagtccataaactggttacttctgatcctggaacgtggacttcacatgataggtctggatctgtttctgttgggatcacaggtaaggaaaatgtccattcaaatggtaaagaagggaggagggtgtttttttttttttttgctgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaaaaaaaaaaaaag

SEQ ID NO: 421609 - DNA, 1722 bp, Homo sapiens
cccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttttagagaggaaaaaacctgtattttcctggtgggatgaaatagggatgaaatggctcagaatggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgttggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctctcgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgtttttttttttttttgctgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttatagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaaaaaaaaaaaaag

SEQ ID NO: 421610 - DNA, 3637 bp, Homo sapiens
ccccaggttcctgcgtgaagacaagttgggagcccaattgtttgttgccaactccaactccggccccttcaccatgcactccttggacgagccgctcgacctgaagttgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggcgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaa

SEQ ID NO: 421611 - DNA, 3953 bp, Homo sapiens
ccccaggttcctgcgtgaagacaagttgggagcccaattgtttgttgccaactccaactccggccccttcaccatgcactccttggacgagccgctcgacctgaagttgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggcgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatggcttgtatgtcgtggatgtgccaggaacccggccctgacatgaggccaccactgccctgagcccctgcaggcctgatccgggctttctccccgaccctgcaggtgcccctccctctcaatctgccgcttagagcaggaactggaaggttgggaaggaggtaggtgctgagggcgcacaggtgacaggaactgagacagaagattccaggcggagcatcccaaggtccaagtcctcagcccactactgcccgctgcggctttggagagtggtgggcaaaggcccttctccccccagccacattctggggtact

SEQ ID NO: 421612 - DNA, 347 bp, Homo sapiens
aagctctggcggctggtaaagctcagaggtggtgggtggtgtcacacacctgtcagctccacaggctgctcctcacattcgtgtggtctgggggcatggctggtgtctgctcccaaggtcacagtgggggttcggaggcaggagtacctggcccactgggactctacactccagcacaccctgaactgtgcctctccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacgg

SEQ ID NO: 421613 - DNA, 2663 bp, Homo sapiens
gtgtggaagtgacgctgcccccgctgcccaaaatgtcggcgcccagagggaggtagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggcaggcgcgggtctgggcagctgggggctggcagaggcggcagctgcggccgcggcctccttgcccccatttgcgtgcggcgcctgcgcgcggcgcttcgaccacggccgcgagctggcggcccactgggcggcgcacaccgacgtgaagcccttcaagtgcccgcgctgcgagcgcgacttcaacgcgcccgcgctgctggagcggcacaagctgacccacgacctgcagggcccgggcgcgcccccagcgcaagcctgggccgcggggccaggcgcagggcccgagacggcgggcgaaggcaccgctgcggaggcgggcgacgctcctctggcttcggaccgcaggctgctcctgggccccgcggggggcggcgtgcccaagctcggggggctgctccccgagggcggtggggaggcgcctgcacctgcggcggccgccgagccctcggaagacaccctgtaccagtgcgactgcgggaccttctttgcgtcggccgcggccctggccagtcacctggaggcccactcgggcccggccacctacggctgcggccactgcggggctctgtacgcggcgctggccgccttggaggagcaccggcgggtcagccacggtgagggcggcggggaggaggcggcggccgccgcccgggaaagggaaccggcgtccggggaacccccgtctggctccggccgcggcaagaagatcttcggctgctccgagtgcgagaagctgttccgctcaccgcgagacctggagcggcacgtgctggtgcacactggcgagaagccgttcccgtgcctggagtgcggcaagttcttccgccacgagtgctacctcaagcgccaccggctgctgcacggcaccgagcggcccttcccttgccacatctgcggcaagggcttcatcacgctcagcaacctctccaggcacctgaagctgcaccggggcatggactgactgccaggctgcgtgcgccctgccctccacccagcctcctggactcggcctggaccaggggacctcgggactgcgcgtgaggccccggccctccaaatccaaatccagacgcaggccctgaaatgaggggaccctgactggagaggtgggggccaccaaaaacccacaaaggccccggagctgggggaccacaaacaaacagggtccttagctggggcaggggagcccaaatctagggagagactcctgagcctgaggtccctggaatgagtgtgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctgatgc

SEQ ID NO: 421614 - DNA, 257 bp, Homo sapiens
gtgtggaagtgacgctgcccccgctgcccaaaatgtcggcgcccagagggaggtgtaagtaattaaagaggaaagccgacggacttccccggcctcccggggccgccccgggtctccaggaccaacgctccgtacgagcgaggtggactcgcctggccccggggcctgcccgacctgccccccaaccgggcgcccagggctgcaccttttaggggcagggggaggggcacaaaaggccggctctcggggcctggggc

SEQ ID NO: 421615 - DNA, 3558 bp, Homo sapiens
ctatcaggtctttataatgaatgtggaaaggacttgcaggggatgggaatagacttcgtagagaaggcctgagaaggtgacgggagtccagtggagagtcttagaaaggatgtggcttctttaaaggaaaaattgggtggagttttggaagtgggtcttagtggacccgagaggggcttagataagtcaaataacttagcaatcatggtaggacttaaggaggaatccaggaggaacttacgggataatagtcatccaaacagcttacttgttgcgtctttgctgtgcaccagcttaagtaggcacgtagcatttattgccacaattttacttaattctcgccaccactccatgaggtaggtactactattcccattttacagatgaagaatttttattatctgatgttacaggagtaattctggtctccctgcaaggatgactccagtgtgcttagccccaaatctttgccctcccattcgctaagtggtcatcctggaagaggagtgggaggagcttagaggggagtgggagggccttttggaaggaaaagggcttggcaaagaatacaagatccttagggaacattgtgggggactttgaagggagtaggtgggacttaaggaagagtgggagaggcttaaattacagtgggaggggcacagagagcagtggccgcgcattggcgaagagcgaggagaggcttaaaaacactccgtggagtgaggagactatgaagtgattaggaagattttgccacaggcgtggagccgcgagagaagggtttctaagagagtaggaggattttaaagaacaatgagagtggcttagagaggtgggcagtgggagggtctcccaggggacaggtggtgggtctgggaacctgggaggagagagctgatggggagccgaccccctcacctgctcctctgtctccccactactccagagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggcaggcgcgggtctgggcagctgggggctggcagaggcggcagctgcggccgcggcctccttgcccccatttgcgtgcggcgcctgcgcgcggcgcttcgaccacggccgcgagctggcggcccactgggcggcgcacaccgacgtgaagcccttcaagtgcccgcgctgcgagcgcgacttcaacgcgcccgcgctgctggagcggcacaagctgacccacgacctgcagggcccgggcgcgcccccagcgcaagcctgggccgcggggccaggcgcagggcccgagacggcgggcgaaggcaccgctgcggaggcgggcgacgctcctctggcttcggaccgcaggctgctcctgggccccgcggggggcggcgtgcccaagctcggggggctgctccccgagggcggtggggaggcgcctgcacctgcggcggccgccgagccctcggaagacaccctgtaccagtgcgactgcgggaccttctttgcgtcggccgcggccctggccagtcacctggaggcccactcgggcccggccacctacggctgcggccactgcggggctctgtacgcggcgctggccgccttggaggagcaccggcgggtcagccacggtgagggcggcggggaggaggcggcggccgccgcccgggaaagggaaccggcgtccggggaacccccgtctggctccggccgcggcaagaagatcttcggctgctccgagtgcgagaagctgttccgctcaccgcgagacctggagcggcacgtgctggtgcacactggcgagaagccgttcccgtgcctggagtgcggcaagttcttccgccacgagtgctacctcaagcgccaccggctgctgcacggcaccgagcggcccttcccttgccacatctgcggcaagggcttcatcacgctcagcaacctctccaggcacctgaagctgcaccggggcatggactgactgccaggctgcgtgcgccctgccctccacccagcctcctggactcggcctggaccaggggacctcgggactgcgcgtgaggccccggccctccaaatccaaatccagacgcaggccctgaaatgaggggaccctgactggagaggtgggggccaccaaaaacccacaaaggccccggagctgggggaccacaaacaaacagggtccttagctggggcaggggagcccaaatctagggagagactcctgagcctgaggtccctggaatgagtgtgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctgatgc

SEQ ID NO: 421616 - DNA, 2965 bp, Homo sapiens
ctatcaggtctttataatgaatgtggaaaggacttgcaggggatgggaatagacttcgtagagaaggcctgagaaggtgacgggagtccagtggagagtcttagaaaggatgtggcttctttaaaggaaaaattgggtggagttttggaagtgggtcttagtggacccgagaggggcttagataagtcaaataacttagcaatcatggtaggacttaaggaggaatccaggaggaacttacgggataatagtcatccaaacagcttacttgttgcgtctttgctgtgcaccagcttaagtaggcacgtagcatttattgccacaattttacttaattctcgccaccactccatgagagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggcaggcgcgggtctgggcagctgggggctggcagaggcggcagctgcggccgcggcctccttgcccccatttgcgtgcggcgcctgcgcgcggcgcttcgaccacggccgcgagctggcggcccactgggcggcgcacaccgacgtgaagcccttcaagtgcccgcgctgcgagcgcgacttcaacgcgcccgcgctgctggagcggcacaagctgacccacgacctgcagggcccgggcgcgcccccagcgcaagcctgggccgcggggccaggcgcagggcccgagacggcgggcgaaggcaccgctgcggaggcgggcgacgctcctctggcttcggaccgcaggctgctcctgggccccgcggggggcggcgtgcccaagctcggggggctgctccccgagggcggtggggaggcgcctgcacctgcggcggccgccgagccctcggaagacaccctgtaccagtgcgactgcgggaccttctttgcgtcggccgcggccctggccagtcacctggaggcccactcgggcccggccacctacggctgcggccactgcggggctctgtacgcggcgctggccgccttggaggagcaccggcgggtcagccacggtgagggcggcggggaggaggcggcggccgccgcccgggaaagggaaccggcgtccggggaacccccgtctggctccggccgcggcaagaagatcttcggctgctccgagtgcgagaagctgttccgctcaccgcgagacctggagcggcacgtgctggtgcacactggcgagaagccgttcccgtgcctggagtgcggcaagttcttccgccacgagtgctacctcaagcgccaccggctgctgcacggcaccgagcggcccttcccttgccacatctgcggcaagggcttcatcacgctcagcaacctctccaggcacctgaagctgcaccggggcatggactgactgccaggctgcgtgcgccctgccctccacccagcctcctggactcggcctggaccaggggacctcgggactgcgcgtgaggccccggccctccaaatccaaatccagacgcaggccctgaaatgaggggaccctgactggagaggtgggggccaccaaaaacccacaaaggccccggagctgggggaccacaaacaaacagggtccttagctggggcaggggagcccaaatctagggagagactcctgagcctgaggtccctggaatgagtgtgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctgatgc

SEQ ID NO: 421617 - DNA, 3498 bp, Homo sapiens
ctatcaggtctttataatgaatgtggaaaggacttgcaggggatgggaatagacttcgtagagaaggcctgagaaggtgacgggagtccagtggagagtcttagaaaggatgtggcttctttaaaggaaaaattgggtggagttttggaagtgggtcttagtggacccgagaggggcttagataagtcaaataacttagcaatcatggtaggacttaaggaggaatccaggaggaacttacgggataatagtcatccaaacagcttacttgttgcgtctttgctgtgcaccagcttaagtaggcacgtagcatttattgccacaattttacttaattctcgccaccactccatgaggtaggtactactattcccattttacagatgaagaatttttattatctgatgttacaggagtaattctggtctccctgcaaggatgactccagtgtgcttagccccaaatctttgccctcccattcgctaagtggtcatcctggaagaggagtgggaggagcttagaggggagtgggagggccttttggaaggaaaagggcttggcaaagaatacaagatccttagggaacattgtgggggactttgaagggagtaggtgggacttaaggaagagtgggagaggcttaaattacagtgggaggggcacagagagcagtggccgcgcattggcgaagagcgaggagaggcttaaaaacactccgtggagtgaggagactatgaagtgattaggaagattttgccacaggcgtggagccgcgagagaagggtttctaagagagtaggaggattttaaagaacaatgagagtggcttagagaggtgggcagtgggagggtctcccaggggacaggtggtgggtctgggaacctgggaggagagagctgatggggagccgaccccctcacctgctcctctgtctccccactactccagagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggcaggcgcgggtctgggcagctgggggctggcagaggcggcagctgcggccgcggcctccttgcccccatttgcgtgcggcgcctgcgcgcggcgcttcgaccacggccgcgagctggcggcccactgggcggcgcacaccgacgtgaagcccttcaagtgcccgcgctgcgagcgcgacttcaacgcgcccgcgctgctggagcggcacaagctgacccacgacctgcagggcccgggcgcgcccccagcgcaagcctgggccgcggggccaggcgcagggcccgagacggcgggcgaaggcaccgctgcggaggcgggcgacgctcctctggcttcggaccgcaggctgctcctgggccccgcggggggcggcgtgcccaagctcggggggctgctccccgagggcggtggggaggcgcctgcacctgcggcggccgccgagccctcggaagacaccctgtaccagtgcgactgcgggaccttctttgcgtcggccgcggccctggccagtcacctggaggcccactcgggcccggccacctacggctgcggccactgcggggctctgtacgcggcgctggccgccgcccgggaaagggaaccggcgtccggggaacccccgtctggctccggccgcggcaagaagatcttcggctgctccgagtgcgagaagctgttccgctcaccgcgagacctggagcggcacgtgctggtgcacactggcgagaagccgttcccgtgcctggagtgcggcaagttcttccgccacgagtgctacctcaagcgccaccggctgctgcacggcaccgagcggcccttcccttgccacatctgcggcaagggcttcatcacgctcagcaacctctccaggcacctgaagctgcaccggggcatggactgactgccaggctgcgtgcgccctgccctccacccagcctcctggactcggcctggaccaggggacctcgggactgcgcgtgaggccccggccctccaaatccaaatccagacgcaggccctgaaatgaggggaccctgactggagaggtgggggccaccaaaaacccacaaaggccccggagctgggggaccacaaacaaacagggtccttagctggggcaggggagcccaaatctagggagagactcctgagcctgaggtccctggaatgagtgtgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctgatgc

SEQ ID NO: 421618 - DNA, 3673 bp, Homo sapiens
ctatcaggtctttataatgaatgtggaaaggacttgcaggggatgggaatagacttcgtagagaaggcctgagaaggtgacgggagtccagtggagagtcttagaaaggatgtggcttctttaaaggaaaaattgggtggagttttggaagtgggtcttagtggacccgagaggggcttagataagtcaaataacttagcaatcatggtaggacttaaggaggaatccaggaggaacttacgggataatagtcatccaaacagcttacttgttgcgtctttgctgtgcaccagcttaagtaggcacgtagcatttattgccacaattttacttaattctcgccaccactccatgaggtaggtactactattcccattttacagatgaagaatttttattatctgatgttacaggagtaattctggtctccctgcaaggatgactccagtgtgcttagccccaaatctttgccctcccattcgctaagtggtcatcctggaagaggagtgggaggagcttagaggggagtgggagggccttttggaaggaaaagggcttggcaaagaatacaagatccttagggaacattgtgggggactttgaagggagtaggtgggacttaaggaagagtgggagaggcttaaattacagtgggaggggcacagagagcagtggccgcgcattggcgaagagcgaggagaggcttaaaaacactccgtggagtgaggagactatgaagtgattaggaagattttgccacaggcgtggagccgcgagagaagggtttctaagagagtaggaggattttaaagaacaatgagagtggcttagagaggtgggcagtgggagggtctcccaggggacaggtggtgggtctgggaacctgggaggagagagctgatggggagccgaccccctcacctgctcctctgtctccccactactccagagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggaagcaaagcaggctttggaggaactggaggaaggccaatgtgactggagcatggagaagcagaaagtgtggctcaggagaagtctggagagtgccggaccctggaaatacagctgtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggcaggcgcgggtctgggcagctgggggctggcagaggcggcagctgcggccgcggcctccttgcccccatttgcgtgcggcgcctgcgcgcggcgcttcgaccacggccgcgagctggcggcccactgggcggcgcacaccgacgtgaagcccttcaagtgcccgcgctgcgagcgcgacttcaacgcgcccgcgctgctggagcggcacaagctgacccacgacctgcagggcccgggcgcgcccccagcgcaagcctgggccgcggggccaggcgcagggcccgagacggcgggcgaaggcaccgctgcggaggcgggcgacgctcctctggcttcggaccgcaggctgctcctgggccccgcggggggcggcgtgcccaagctcggggggctgctccccgagggcggtggggaggcgcctgcacctgcggcggccgccgagccctcggaagacaccctgtaccagtgcgactgcgggaccttctttgcgtcggccgcggccctggccagtcacctggaggcccactcgggcccggccacctacggctgcggccactgcggggctctgtacgcggcgctggccgccttggaggagcaccggcgggtcagccacggtgagggcggcggggaggaggcggcggccgccgcccgggaaagggaaccggcgtccggggaacccccgtctggctccggccgcggcaagaagatcttcggctgctccgagtgcgagaagctgttccgctcaccgcgagacctggagcggcacgtgctggtgcacactggcgagaagccgttcccgtgcctggagtgcggcaagttcttccgccacgagtgctacctcaagcgccaccggctgctgcacggcaccgagcggcccttcccttgccacatctgcggcaagggcttcatcacgctcagcaacctctccaggcacctgaagctgcaccggggcatggactgactgccaggctgcgtgcgccctgccctccacccagcctcctggactcggcctggaccaggggacctcgggactgcgcgtgaggccccggccctccaaatccaaatccagacgcaggccctgaaatgaggggaccctgactggagaggtgggggccaccaaaaacccacaaaggccccggagctgggggaccacaaacaaacagggtccttagctggggcaggggagcccaaatctagggagagactcctgagcctgaggtccctggaatgagtgtgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctgatgc

SEQ ID NO: 421619 - DNA, 5276 bp, Homo sapiens
  misc_feature (1054)..(1054): n is a, c, g, or t
ctctatgggaggagaccacccggaggatgaagaggatttctacgaggaagagatggactatggagagagtgaggagccaatgggagacgacgactatgacgagtactccaaggagctgaaccagtaccgccgctccaaggacagccgaggccgagggctaagtcgaggccgtggcaggggctcccgaggtcgagggaaaggaatgggtcggggccgaggccgaggtggcagccgaggagggatgaacaagggcggaatgaacgatgacgaagacttctatgacgaggacatgggcgacggtggtggtggaagctaccggagtcgtgaccatgacaagccccaccagcagtcggacaagaaaggcaaagtcatttgcaagtacttcgtggaagggcgctgcacctggggagaccactgtaattttagccatgacatcgaactgccaaagaagcgagaactgtgcaagttttacatcactggattttgcgccagagctgagaactgcccttatatgcacggtgatttcccgtgtaagctgtaccacaccactgggaactgcatcaatggtgacgactgcatgttttcccacgaccctctgaccgaagagacgagggagctcttggataagatgttggccgatgatgcagaagcaggtgccgaggatgagaaggaggtggaggaactgaagaagcagggcatcaaccccctgcccaaaccgccccctggtgtgggcctcctgcccacccctcctcggccccctggcccgcaggctccaacctctcccaacggcaggcccatgcagggtggccccccgcccccgccccctccccctcccccaccgcccgggccccctcagatgcccatgccggtgcatgagccactgtccccgcagcagctgcagcagcaggacatgtacaacaagaagatcccctccttgtttgagatcgtggtgcggcccacgggacagctggctgagaagctgggtgtgaggttccctggacccggtggacccccagggccaatgggccctgggcccaacatgggacccccaggnccaatgggcggtccaatgcatcctgacatgcaccccgacatgcacccggacatgcaccctgacatgcacgcagacatgcacgcagacatgccgatgggccctggcatgaatcctggcccacccatgggccctggcggccctccaatgatgccctacggccctggagactccccacattctggaatgatgccccctatcccgccagcccagaacttctatgaaaacttctaccagcagcaggagggcatggagatggagcccggactcctgggggatgcagaggactacgggcactacgaagagctgccaggggagcctggggagcacctcttccctgagcaccctctggagcccgacagcttctctgagggagggcccccaggccggccgaagccaggcgccggtgtccctgacttcctgccctcagcccagagggccctgtacctgaggatccagcagaagcagcaggaggaggaggagagagcgaggaggctggctgagagcagcaagcaggaccgggagaatgaggaaggtgacaccggaaactggtactcaagtgatgaggatgagggtggaagcagtgtcacctccatcctgaagaccttgaggcagcagacgtccagccgacccccggcttcagttggggagctgagcagcagtgggctgggggacccccgcctccagaagggacaccccacaggaagccggctggctgaccctcgcctcagccgggaccccagactcacccgccatgtggaggcttctggcgggtctggcccaggtgattcgggaccctccgatcctcggctggctcgcgccctgcccacctccaagcccgaaggcagccttcattccagccctgtgggccccagcagttccaaggggtctgggccgcccccaacggaggaggaggaaggggagcgggccctgcgggagaaggccgtgaacattcccctggacccactccccgggcaccctctgcgggacccacggtcacagctgcagcagttcagccacatcaagaaggacgtgaccctgagcaagcccagcttcgcccgcaccgtgctctggaatcccgaggacctgatccccctacccatccccaagcaggacgcagtgccccccgtgcccgcggccctgcaatccatgcccaccctggacccccggctgcaccgcgctgccacggcagggccccccaacgcccggcagcgcccgggcgcctccacggattccagcacacagggcgccaacctccccgactttgaacttctgtctcgcatcctcaagacagtcaatgccaccggctcctcggccgcccccggttccagcgacaaacccagtgacccccgggtgcggaaggcccccaccgaccctcggctgcagaaacccacagactctacggcctcctcccgggctgccaagcccggccctgctgaggcgccctctcccaccgccagcccgagtggggatgcctccccaccagccaccgctccctacgacccccgcgtgctggcggccggtggactgggccagggcggagggggcgggcagagcagtgtgctgagcggtatcagcctctacgacccgaggactcccaacgcggggggcaaagccacagagccggctgctgacacgggtgcccagcccaagggtgctgagggcaatggcaagagctcggcctccaaggctaaggagcccccgttcgtccgcaagtctgccctggaacagccagagacagggaaggccggtgctgatgggggcacccccacggacagatacaacagctacaaccggccccggcccaaggctgctgcagcccccgctgccaccaccgccaccccaccccccgagggtgccccaccccagcccggggtgcacaacctgcccgtgcccaccctcttcgggacggtgaagcagacacccaagacgggctcaggaagcccatttgctgggaacagtccggcccgcgagggtgagcaggatgcggcatccctgaaggatgtttttaaaggcttcgaccccacggcctcccccttttgccagtagtgtccagccagagctgcggctccagccacccttcctagggtggcattcagggcagcacccagggtagggaacttgggggcaaggggaggcaggctgggtgttccttttttcttttctttttcttttgctttccgtctcttttatttttttttaaagtagtactttctttgagatttgtaaattgtatataaccatcttaagttctggtcagtgtggcgggctcaggggctcctgctgagcaaaccgactcatgcccgcaaacctgtgaactttcgccagtgcctggcctcagactctgtgggctctgcgtggccgggccttgctggaggcccagtgggttttctgggcaaagcatggccccttttccccaggacaaagggaacagttggtgtctgggaaggtattgaacgctcctcaccctgtgcccgaagagacccggaaccaagaccatggcagggcctgcgtggaagcaggtccaggcgtttctagaaccctagggtgcaccatcactgtcttttcagtgcaggctgtaacaacccactcaggagacagtgagagtgaaaaggtattaaggaaaaagcccccagcggcactatgggggctccctggtgcatgcctgctcctgtccctggattaccacacgtgccctccctgccaccctccgtctagagcaagcggatgccccccagcctgcagcagaagcctccacagtgagaactggacccaaaggtagtgggggccggtgtggggcagagtcctgaagagccacctctaggaggcagcccctaggagcacgcacgttctgtcagtattaccccacctgtcctatcaggtgggccacaccctgcttgcccacaccagggtctgtcctggtcctcaagccacgcacccgctatgcctgcactgcagcccagccccggacagctccaggatccgtgcagtggctgcgccgccaggccccaacaatggggaccctggggtggctcctggccaagtgttctctgttttcctcgcacctccttacactgtgtgacctgcagggcatgaggtattgatgtgttcgggtttcctttcccaagccagcagatgcaggtgttccaaggtgtgttgctctgtgggatttgtggacacttaagaaacggactgagtgggaaccctgcagccaggggatggggagcctctgctccccccatgctcccaccctggctgagggccagcctcatctgcagagccctggaggaggcccacctatggacacagcccgagagatgggcgcaaggggtgctgggggaggcctgctatcctgcctctgggccacttgaggggcctcaggaagtgtgtgcttgtggctgcatctgcccgtctccctggcccaccatgtggctgcaggccaagctcttcattgctgaccatgaagagacctagttacctgccaagggattccccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtcttttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttattttaaaaaaaaaat

SEQ ID NO: 421620 - DNA, 468 bp, Homo sapiens
gggaattttttggccaaaattttcaaccaatccatatagcctgaaacgtaattatggaggttgatgtgaatgcaaagcagcagcatatcctggtgaagttattgagcttcagggttgaatggggaatgattaaagcatccaaacagaagaggaggggaggatgaggttaaccttggacttcatagcagagttcaatgtcagaagatggaccaatgaccacagagttctgaaggaaacaagtataataacccagtattagttcagccggcagcttcttaccccagtatcccaggcagcaacagacaccagcagatgtgtgctcagggcacactgcacccctgcatctgtcttgggaagaaatagatgcttcaaacaaataatgttgtgtataaaataatttgttttttcctttgagaccaagtctcactgtcactccagcctaggcgacagagcaagactctgtcactg

SEQ ID NO: 421621 - DNA, 800 bp, Homo sapiens
tcatgctgttctagaggatcccgaaaatgacatagaggcagatgatgagcacattgatatggtggcgactctataaaggccgggccctgaatgactacggtgaatggtgccccctgctgagccgcaatggaagtgtagcaggaagaaaaagcaaatctttgctgaattcagccactaagacttttggggttgttttctacaccacatacattttttttctgtttctttctttttgtcttttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttattttaaaaaaaaaat

SEQ ID NO: 421622 - DNA, 832 bp, Homo sapiens
cccgatcccatctctacccttccctttcattcccctttacgtccacaccctgtccattgcaggacggtggtggtggaagctaccggagtcgtgaccatgacaagccccaccagcagtcggacaagaaaggcaaagtcatttgcaagtacttcgtggaagggcgctgcacctgggtaaggagcgctgaaagctgggcacctctaggaggccatagcccccagaggacacatggcttccagaaggttctggagccgtggtgagggtgggtgggagtgactgtgtagtccttgtccttgtggacacttgccgatactgggagttgcctgggcggcctgaaagactcaggttacctttcagagtgaggaggacccccagtaagatgaggacttttggttttaggggaattttttggccaaaattttcaaccaatccatatagcctgaaacgtaattatggaggttgatgtgaatgcaaagcagcagcatatcctggtgaagttattgagcttcagggttgaatggggaatgattaaagcatccaaacagaagaggaggggaggatgaggttaaccttggacttcatagcagagttcaatgtcagaagatggaccaatgaccacagagttctgaaggaaacaagtataataacccagtattagttcagccggcagcttcttaccccagtatcccaggcagcaacagacaccagcagatgtgtgctcagggcacactgcacccctgcatctgtcttgggaagaaatagatgcttcaaacaaataatgttgtgtataaaataatttgttttttcctttgagaccaagtctcactgtcac

SEQ ID NO: 421623 - DNA, 1901 bp, Homo sapiens
  misc_feature (1054)..(1054): n is a, c, g, or t
ctctatgggaggagaccacccggaggatgaagaggatttctacgaggaagagatggactatggagagagtgaggagccaatgggagacgacgactatgacgagtactccaaggagctgaaccagtaccgccgctccaaggacagccgaggccgagggctaagtcgaggccgtggcaggggctcccgaggtcgagggaaaggaatgggtcggggccgaggccgaggtggcagccgaggagggatgaacaagggcggaatgaacgatgacgaagacttctatgacgaggacatgggcgacggtggtggtggaagctaccggagtcgtgaccatgacaagccccaccagcagtcggacaagaaaggcaaagtcatttgcaagtacttcgtggaagggcgctgcacctggggagaccactgtaattttagccatgacatcgaactgccaaagaagcgagaactgtgcaagttttacatcactggattttgcgccagagctgagaactgcccttatatgcacggtgatttcccgtgtaagctgtaccacaccactgggaactgcatcaatggtgacgactgcatgttttcccacgaccctctgaccgaagagacgagggagctcttggataagatgttggccgatgatgcagaagcaggtgccgaggatgagaaggaggtggaggaactgaagaagcagggcatcaaccccctgcccaaaccgccccctggtgtgggcctcctgcccacccctcctcggccccctggcccgcaggctccaacctctcccaacggcaggcccatgcagggtggccccccgcccccgccccctccccctcccccaccgcccgggccccctcagatgcccatgccggtgcatgagccactgtccccgcagcagctgcagcagcaggacatgtacaacaagaagatcccctccttgtttgagatcgtggtgcggcccacgggacagctggctgagaagctgggtgtgaggttccctggacccggtggacccccagggccaatgggccctgggcccaacatgggacccccaggnccaatgggcggtccaatgcatcctgacatgcaccccgacatgcacccggacatgcaccctgacatgcacgcagacatgcacgcagacatgccgatgggccctggcatgaatcctggcccacccatgggccctggcggccctccaatgatgccctacggccctggagactccccacattctggaatgatgccccctatcccgccagcccagaacttctatgaaaacttctaccagcagcaggagggcatggagatggagcccggactcctgggggatgcagaggactacgggcactacgaagagctgccaggggagcctggggagcacctcttccctgagcaccctctggagcccgacagcttctctgagggagggcccccaggccggccgaagccaggcgccggtgtccctgacttcctgccctcagcccagagggccctgtacctgaggatccagcagaagcagcaggaggaggaggagagagcgaggaggctggctgagagcagcaagcaggaccgggagaatgaggaaggtgacaccggaaactggtactcaagtgatgaggatgagggtggaagcagtgtcacctccatcctgaagaccttgaggcagcagacgtccagccgacccccggcttcagttggggagctgagcagcagtgggctgggggacccccgcctccagaagggacaccccacaggaagccggctggctgaccctcgcctcagccgggaccccagactcacccgccatgtggaggcttctggcgggtctggcccaggtgattcgggaccctccgatcctcggctgtccttggagcgccggtactggttcagctccttggatg

SEQ ID NO: 421624 - DNA, 2317 bp, Homo sapiens
catcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggatgaggatgaagaagtatacaagagagatttcagcgctcctaccctggaggatcatttcaataaaaccattcttcctaaagtcatgcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggcagaaggtgtttcacattttgataattccctttgatctcagaaacaagctcaggtactagcttggctttaggtagcatctggatttattccatgaccaaatacagatgtttttgagaagaccaaggtcttctcacatcctttaaatgtcccactggaagaatcaaatagtttagtgtcgtacgataaaaatgaatgcaaatgtcgctggccgt

SEQ ID NO: 421625 - DNA, 2016 bp, Homo sapiens
catcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggatgaggatgaagaagtatacaagagagatttcagcgctcctaccctggaggatcatttcaataaaaccattcttcctaaagtcatgcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaaca

SEQ ID NO: 421626 - DNA, 2060 bp, Homo sapiens
catcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggatgaggatgaagaagtatacaagagagatttcagcgctcctaccctggaggatcatttcaataaaaccattcttcctaaagtcatgcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacacacgacaaagaggataaaagaacagagacataacctataaaaag

SEQ ID NO: 421627 - DNA, 1345 bp, Homo sapiens
cacgaggaagaatgtcatctcttcaactagatgtaagctcttgaagaaaggctcaataccctctgctttctctgtatcccttattgtagagtttaataaatttgtggtttgaatatataggaaataaagccacaagattgataagattttttttatacaggatgaggatgaagaagtatacaagagagatttcagcgctcctaccctggaggatcatttcaataaaaccattcttcctaaagtcatgcaggtatggggaaccttaataacatgacagagaaaagtgatgtattgatagctgaggcatggtttgtttggtggtataactcatcatccatccttccctcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggcagaaggtgtttcacattttgataattccctttgatctcagaaacaagctcaggtactagcttggctttaggtagcatctggatttattccatgaccaaatacagatgtttttgagaagaccaaggtcttctcacatcctttaaatgtcccactggaagaatcaaatagtttagtgtcgtacgataaaaatgaatgcaaatgtcgctggccgt

SEQ ID NO: 421628 - DNA, 1466 bp, Homo sapiens
catcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgtgagtaaaaagatgagcctagagttaatgctgctaatggaacaggtttctagcaggatagctctgagactcattacctactgtgagttccattctagccaccttcagagttcttgttgctttgtgagtttcctataattggaatatgagtttcacttgctacagtgaaatcagggaagagaaaaacactttgtcgatgtgtgtccataatagagtgccagccagtgctccctttagtttcctagtagacacaaaaattagtaactgttagtagttatctcttcttgtgtacaacccaacccacaattgagtgacttgaaactataatttattacttttcacaactttggaggttggctgaacagttcctctactgatttcacctgggcttactt

SEQ ID NO: 421629 - DNA, 1113 bp, Homo sapiens
catcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgctttctggcagcaggcagctcagcacatcacgcagtctgcagctaatggaagcagctacaacagagcagctgcaagcatgcacgatggcaggccctcgccctttaaaggccaaggtcttccatgtcccggaacactaaagacacaagggaaacccccggcgaagccgttggaaccaaagggttctccccccacagggggaaaacccgcgtggcgaaccaaggggccccccggacaacaaggccccgcgacattctcgcgacataaaacaccacaggtaacccgccgggaaacgagcactcttgccgccaaggcgcacaaacgagggcgaaacaacggcccccaaccaacatcataccggtcacccacttggggcccccgttggacaacgtggcgcaaccacaaggggg

SEQ ID NO: 421630 - DNA, 611 bp, Homo sapiens
catcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagagcgtgacatcatgtgtccggctc

SEQ ID NO: 421631 - DNA, 635 bp, Homo sapiens
agtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtacggtgctaacaccctcttcccagtcgaattttaaccccttccggccccagcaacctccagacctctcccggacagaccactccaaccccgccagctcttgagatctggctgccagattcttcgatctttccacccccacccacttgcatccgatcttgttcctgtggcctgctctcgtattcagcaagcacctctcttctgttagcctccacaaattccttagactaatgttacatatatataatatatattacacatataaaaacattaggaacttaagtatatatcagaatatatatgtctaatatatatatgctagaatatatgtattagtctaatatatattatgattagaatataatatcactaattacatataattacaagaatttatgtattattagtgtaattacttaggaactt

SEQ ID NO: 421632 - DNA, 2326 bp, Homo sapiens
aaaattaggaaattgcgactaccttgagtgcctttctgtcactatgtcctctctccccgtagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggatgaggatgaagaagtatacaagagagatttcagcgctcctaccctggaggatcatttcaataaaaccattcttcctaaagtcatgcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggcagaaggtgtttcacattttgataattccctttgatctcagaaacaagctcaggtactagcttggctttaggtagcatctggatttattccatgaccaaatacagatgtttttgagaagaccaaggtcttctcacatcctttaaatgtcccactggaagaatcaaatagtttagtgtcgtacgataaaaatgaatgcaaatgtcgctggccgt

SEQ ID NO: 421633 - DNA, 1555 bp, Homo sapiens
tttaaagctaagaagaccttttagggaaagagaatttgtaatgttggaaaacccagcagtaatagtatgtctgaacgtcagaagggctagaattaacttttgaaagttggcaatacctagtctagcaaacataatgaagactaactcacccatttgtttattgagctccttatcttgattcctaataggcaatgactagaattaaagaaggtgactaatacttgaaatgacatgggactgttattttcagataatttggtctttctgaagctgtaacagtaccaataaattgttttgctccctggacaggcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggatgaggatgaagaagtatacaagagagatttcagcgctcctaccctggaggatcatttcaataaaaccattcttcctaaagtcatgcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggcagaaggtgtttcacattttgataattccctttgatctcagaaacaagctcaggtactagcttggctttaggtagcatctggatttattccatgaccaaatacagatgtttttgagaagaccaaggtcttctcacatcctttaaatgtcccactggaagaatcaaatagtttagtgtcgtacgataaaaatgaatgcaaatgtcgctggccgt

SEQ ID NO: 421634 - DNA, 1532 bp, Homo sapiens
catcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggtaagaagtgaaaagagagtcagaaaattgggcagtaggaataactcagaaactttgaattatttttctcttcaagaatattctggaatgtaatttccacttgccagtggtcagctttctcatttgctttttccttctgaacaatataaactcagagaaaagcatcagcaattggatgacagaagtagcatcaactgttctctcttttggccccaactctcaaaaataggaaatgatgtaatagactttttttttttttttaagagacagagtctcgctgtcacccaggctggggtacggt

SEQ ID NO: 421635 - DNA, 635 bp, Homo sapiens
catcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgagtcgcgctggaccgctcgatcac

SEQ ID NO: 421636 - DNA, 367 bp, Homo sapiens
ctaaattacggccgcgtcgacttttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgtta

SEQ ID NO: 421637 - DNA, 1340 bp, Homo sapiens
ccttttcccggcgtccatttagtggcgggaaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcagaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgtta

SEQ ID NO: 421638 - DNA, 1392 bp, Homo sapiens
ccttttcccggcgtccatttagtggcgggaaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgtta

SEQ ID NO: 421639 - DNA, 722 bp, Homo sapiens
ccttttcccggcgtccatttagtggcgggaaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattgcgtatgtagaacactttttttttggcagaacacattttgcttactttatagattgataaggccagatctcttagccactgagaaatttcctaatttccgacttccaaaattccttaaaatttttgacatggcaacttaaaaagtga

SEQ ID NO: 421640 - DNA, 584 bp, Homo sapiens
gcacccaccaccgtgcccagctaattgtttgtaattttagtagagatgggctttcaccatgttggccagactggtcttgaattcctgacctcaggtgatccgccctcctctgcctcccagagtgctaggattacaggcgtgagccaccatgcctggcccatgctccttctttgtaagaaaatttcaaacccgcatttatataaattggctagaatttaaattgcatagccacactttagccataagacaggttgcggaaataatggtcattactctaggtgttaatagctgttaaggaaaaaaaaaatcaacattctgtcagtagaaatgagaaagtagaaatacactttgggacacatctaattcagtcataattttggaacagagtctgctaaatagagcagaaatataattatcaacttttctgctaaataaaattcaagttttatttcttgcttagggagaacctctcagactgtgtttttcctctgctgtcacatcacaataatcatcaacaaagaagtctgtaagagcaaactgctggtttaaaaaaaaccatttttttcaataaaattaaaaaaaaa

SEQ ID NO: 421641 - DNA, 472 bp, Homo sapiens
tcttgccaagctgcactgcagctgggggtcggggtggggagggtcatatccccagactccttgaagctgttgtcactccactctcctaggcgctgtcctgggctggctgatgactccccgagtgcctatggagcgggagctaagcttctatgggttgactgcactggccctcatgctaggcaccagcctcatctattggaccctctttacactgggcctggatctttcttggtaagtcccgcccagaggttccagggagaagaccaggccaccgcccactgcccggcgtcggggaggaaagaggaggagcctctgtgtgcccacatctctggccgcccagggcagctcggctcggtctcgcaaccccagcccactggttcgggagacctcaaaggctccaccgccagcgcccccagcgctcactgtgtgcgccccaccccagccctgccgttatagatcgcgagcggccgct

SEQ ID NO: 421642 - DNA, 2556 bp, Homo sapiens
cgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttgaaaaaaaaaaaaaaaaaaaaaaaaaaaaaaaaaacaaaaaaaaagagggcggcgcgcgagcacaaagagaatccactccaggagggggccaaaaagaaaacgcgaacacacccacgcatcttggaccaaaaggggaccctataataagagacagcactataacgagacacagagagaccacccggccccgcaatacgcaaacgccgagcgcacagaacagcgagcgcgaccaacacccgccgacacccggaacaacaagcggcgacgagagaccaagacaacagagagggaggcacacaacagtcggcgacaaacacaccaacagcgagaactacacaaccacctcagagggcacacactaatcccaatgccaaacggggtgaacacggcgggtcaacaaccaaaaagaagaaaaagagacaagaagggaccaaaaacacagcgcacaccacgaggagaagacgaaacagcaaacagcatccaaccagcaggcaaccacaaaaatcaaacacacggaccaaacacaaaccacacccacacacacaacgcgaaaaacagaagaaagaaccataccgccacgacacagcgacaacgcagagcagacacacacaccaccaacagagaacgaagcacacacgcaccaccccagccgcacccaggagacaacaagacaaaaaaaagacaggagaggcagggaggcagacagcaaccgagccaccgcaccacgagcaagaccacacagcgaagaacaaaaacgacaacgcaaaaggcgaagacgaagagaccaaataaacgaaagaacaagagagtcaaaaagaaagcagaaagagcaccgaaaccacccaacgcgacagcgcgacacggccgacgaacaggagcgaaagaccaggaccccacgacgcaagcagacacacaaagcgagacacgagagacagacgagcccgacgcgaacgcaagacgagaaaggaagaacagaagcgacaaacacagaaaaacagagcaaaacacc

SEQ ID NO: 421643 - DNA, 1742 bp, Homo sapiens
cgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtgaagcatgctttgtgctgggcatcacggtagctgctaaggacagagacaccttgcagattaaggtgtggtccctggaccatgcccaacggcataggcagcacttgaaaactggctaaaaacgcagactctcaggccccgggccagagctactgaatcaaaatctgcattttaacaaggttcccaggtgattccctgtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421644 - DNA, 1075 bp, Homo sapiens
cacattactcgacttcaaaccatactatgaggctacggtgaccaaaacaacatggtgctggtacaaaaacaggcacatagaacaatggaacaaagtagacagcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421645 - DNA, 1429 bp, Homo sapiens
cgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcaggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421646 - DNA, 1098 bp, Homo sapiens
cgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421647 - DNA, 439 bp, Homo sapiens
cgcaggaggaaacagtaccggctggaggccggtcttgcaggagcgggggactgctgggggcggggcttggtggtgaccgctgcctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421648 - DNA, 1548 bp, Homo sapiens
cgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421649 - DNA, 1607 bp, Homo sapiens
cgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtgtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421650 - DNA, 1801 bp, Homo sapiens
cgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtaagcatgctttgtgctgggcatcacggtagctgctaaggacagagacaccttgcagattaaggtgtggtccctggaccatgcccaacggcataggcagcacttgaaaactggctaaaaacgcagactctcaggccccgggccagagctactgaatcaaaatctgcattttaacaaggttcccaggtgattccctgtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421651 - DNA, 1582 bp, Homo sapiens
cgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactgactccttgaagctgttgtcactccactctcctaggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421652 - DNA, 524 bp, Homo sapiens
gatcatcatcggtgacatcagcaccagcactgagtgcacgcctgtacccttgcctgatgccaagcaaagactctttcccagaggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 421653 - DNA, 2027 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtaattctcaaactatgtgttatttatgtaatctgatacataatctctttcactgaaatcttgtgatccattctttacctttccattttaataatggttaaaatatttgaaacatttactagta

SEQ ID NO: 421654 - DNA, 2185 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421655 - DNA, 3089 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421656 - DNA, 2996 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421657 - DNA, 3052 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggta

SEQ ID NO: 421658 - DNA, 3169 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtaagcgttccagaacagctgcttcttcacctcctgagccactcactaatcagaagacatgttgttgaaattgttcacgtgtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421659 - DNA, 2784 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421660 - DNA, 2813 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctaggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421661 - DNA, 3186 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaaaaaaaaaaaaaaaaaaaaaaaaaaaaaaaaaaaaaaaaaaaaaaaaaaaaaaaaaaaaaaaaaaaaaaaaaaaattaaaaaaaaaaaagaaaaaaaa

SEQ ID NO: 421662 - DNA, 2476 bp, Homo sapiens
cgagctcggtaccccgtccttcatcatacctacccagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtaagcgttccagaacagctgcttcttcacctcctgagccactcactaatcagaagacatgttgttgaaattgttcacgtgtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421663 - DNA, 1178 bp, Homo sapiens
gggacacagctgtccagctcagctgagagcacaggagcctccggggcatcagcgactggccggggtgagggatgccaccaggtgcagaggtggaggctcagggcgtgctggggaggaagagaggcttgtggaaaagtccagagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421664 - DNA, 1374 bp, Homo sapiens
atggcaatattttgactttggatacttttgagttgtcgtagacctgtcttcaatgcctttccccccacaggcgacattgactacagcaccgtgctcctcggcatgctggtgacgcaggacgtgcagctcgggctcttcatggccgtcatgccgactctcatacaggcgggcgccagtgcatcttctaggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421665 - DNA, 1105 bp, Homo sapiens
gagatgggaaggaagcctggaatctctggaacaggacattcccaagcaggaaggaagccagtggggctggagatgaaggggaggctttccaccgggcagcagcggggagaaaacgcagcccggaacgcccaagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 421666 - DNA, 1118 bp, Homo sapiens
ctcttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtaagcgttccagaacagctgcttcttcacctcctgagccactcactaatcagaagacatgttgttgaaattgttcacgtgtatgtttttaatgtagattgaaaatgaagacaaactaaaatgcttctct

SEQ ID NO: 421667 - DNA, 569 bp, Homo sapiens
ataaagatgtagctgacctttaatcatctcagcccttcacaaagcaccatacaaggtacatcaacattcagtatttgattttaatctcagtgaaataaatagtttagatgttgatatttatctaggaaaaatgagaatttcttcagaaaggtgtcagtttttcagatctgattatttaatactctgatcaatagtaatgaatcattgtttaactatgtgtgacaataactctttttcagctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcc

SEQ ID NO: 421668 - DNA, 432 bp, Homo sapiens
gcgacattgactacagcaccgtgctcctcggcatgctggtgacgcaggacgtgcagctcgggctcttcatggccgtcatgccgactctcatacaggcgggcgccagtgcatcttctaggtaaacgctttgtgtacgcaatttgtttttatagtttaaaatcacttgtgcataaaaatactacttaataccttttccaaagagatgttctgagctcagatggctcaggattccgtgcacagtccctggagcaacactgccttgctcacgccctggctctgtgcttagcagctcctcaccacgggcaggtgacttatcctcacagttcctcagtcctgtcttccatcaagtaggggtggtagtagtacccactgatggagtagtcaggaggaatgaatgagttccgatagaaacatgcttagaacaatgtccag

SEQ ID NO: 421669 - DNA, 3063 bp, Homo sapiens
tgccgggaggcggggcgcagggatccggaaacacctgatcatctataggtttagtgcctaatgggtgttgttcctggctggacttgatgtccagggcctgaggggttttctcgccgagtctcctggggcggtccggaggctcgtgccctgttgtggggcccccatttgccgccgccatgcccacggccgccgcccccatcatcagctcggtccagaagctggttctgtatgagactagagctagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggggtatttgggatctgtagtgagccttatatgaaatatgtatggaatggtgaacttctggatataattaaaagtactgtgcatcgtgactggcttttgtatattattcatgggttctgtgggcagtcaaagctgttgatctatggacgaccagtgtatgtcactctaatagctagaagatccagtaaatttgctggcacccgttttcttaaaagaggtgcaaactgtgagggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacattggatcaggcagatccatttgcacatgtggctgcccttcactttgaccagatgttccagaggtttggctctcccatcatcatcttgaatttagtgaaggaacgagagaaaagaaagcatgaaagaattctgagtgaagaacttgttgctgctgtgacctatctcaaccaatttttgcctcctgagcacactattgtttatattccctgggacatggccaagtataccaaaagcaagctgtgtaatgttcttgatcgactaaatgtgattgcagaaagtgtggtgaagaaaacaggtttctttgtaaaccgccctgattcttactgtagcattttgcggccagatgaaaagtggaatgaactaggaggatgtgtgattcccactggtcgcctgcagactggcatccttcgaaccaactgtgtggactgtttagatcgcaccaacacagcacagtttatggtgggaaaatgtgctctggcctatcagctgtattcactgggactgattgacaaacctaatctacagtttgatacagatgcagttaggttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgagaatgtggtccaacccatgaaggagctatatggaattaacctctcagatggcctctcagaagaagatttctccatttattcaagatttgttcagctggggcagagtcaacataaacaagacaagaatagccagcagccctgttctaggtgctcagatggagttataaaactaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagataatt

SEQ ID NO: 421670 - DNA, 453 bp, Homo sapiens
agtcagcctgcttattcaatgccagcgactctcaagtgcttctgagactgctccctgtggtccttccttatattttctttaatgcagccctctctttattcatcttttatagaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagataatt

SEQ ID NO: 421671 - DNA, 886 bp, Homo sapiens
gggagatgaaagttgttaggataatttttactcttacttgttcaagattgttagcatatatgtatgcatttattgcctgccttgttccaaaaggatttaaggaagctccctcccacccccatcacagaaagtagaataaaacaagaaccacatgagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggggtatttgggatctgtagtgagccttatatgaaatatgtatggaatggtgaacttctggatataattaaaagtactgtgcatcgtgactggcttttgtatattattcatgggttctgtgggcagtcaagtatcctttctgaagaaaaagta

SEQ ID NO: 421672 - DNA, 432 bp, Homo sapiens
caaccgctacttcctgccacctcttgactttatttatatatttgtaacatgtcctcaatttccttgtcattttcttttctctcaagaactctcacaagtcagaaaagggatttctttgactttttacagaatcaacacaatgttctggacatgaaaggaatgatatccactgaaaatggcaatgctattaaccaagcatgttactttgaagttaaaaacagaagttaacttaaaaatgagttgaatgtcagccaatttccatatctttctgataccaaccttttttttaattgatacaaaatattttgtgtatttatggactgatacagacttttatttttcaggggtatttgggatctgtagtgagccttatatgaaatatgtatggaatggtgaacttctggatataattaaaagtactgtgcatcgtga

SEQ ID NO: 421673 - DNA, 506 bp, Homo sapiens
caacgtctggctatcagcgtatcactgggacgatgaactatcacagtttgatacagaatgcagttaggttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagggttcctagcaagatctcctgcgaatctggaatgctccaattgaggactccatctagtcatgcttcagcatccc

SEQ ID NO: 421674 - DNA, 2585 bp, Homo sapiens
caaccgctacttcctgccacctcttgactttatttatatatttgtaacatgtcctcaatttccttgtcattttcttttctctcaagaactctcacaagtcagaaaagggatttctttgactttttacagaatcaacacaatgttctggacatgaaaggaatgatatccactgaaaatggcaatgctattaaccaagcatgttactttgaagttaaaaacagaagttaacttaaaaatgagttgaatgtcagccaatttccatatctttctgataccaaccttttttttaattgatacaaaatattttgtgtatttatggactgatacagacttttatttttcaggggtatttgggatctgtagtgagccttatatgaaatatgtatggaatggtgaacttctggatataattaaaagtactgtgcatcgtgactggcttttgtatattattcatgggttctgtgggcagtcaaagctgttgatctatggacgaccagtgtatgtcactctaatagctagaagatccagtaaatttgctggcacccgttttcttaaaagaggtgcaaactgtgagggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacattggatcaggcagatccatttgcacatgtggctgcccttcactttgaccagatgttccagaggtttggctctcccatcatcatcttgaatttagtgaaggaacgagagaaaagaaagcatgaaagaattctgagtgaagaacttgttgctgctgtgacctatctcaaccaatttttgcctcctgagcacactattgtttatattccctgggacatggccaagtataccaaaagcaagctgtgtaatgttcttgatcgactaaatgtgattgcagaaagtgtggtgaagaaaacaggtttctttgtaaaccgccctgattcttactgtagcattttgcggccagatgaaaagtggaatgaactaggaggatgtgtgattcccactggtcgcctgcagactggcatccttcgaaccaactgtgtggactgtttagatcgcaccaacacagcacagtttatggtgggaaaatgtgctctggcctatcagctgtattcactgggactgattgacaaacctaatctacagtttgatacagatgcagttaggttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgagaatgtggtccaacccatgaaggagctatatggaattaacctctcagatggcctctcagaagaagatttctccatttattcaagatttgttcagctggggcagagtcaacataaacaagacaagaatagccagcagccctgttctaggtgctcagatggagttataaaactaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagataatt

SEQ ID NO: 421675 - DNA, 1235 bp, Homo sapiens
gagcaaaaaggaatttaaagaacctcctctaaataactgcctgctcccattggacttcctgaggccctcctggctccttagagcttgttgaactcagctttgcattgtattttctatgcatctatctcatctcctttctaactgtgtaagtgttggaggcaggagcttaccctcggtcagggctgtatcccccacagagcttatcacagtgctgtctgtgaacacagttaatattatggaaatgtttgcttgctataatctcagacttttagagtaacatgcagtatctctcttagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgagaatgtggtccaacccatgaaggagctatatggaattaacctctcagatggcctctcagaagaagatttctccatttattcaagatttgttcagctggggcagagtcaacataaacaagacaagaatagccagcagccctgttctaggtgctcagatggagttataaaactaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagataatt

SEQ ID NO: 421676 - DNA, 777 bp, Homo sapiens
cagagtgatagacagtgggtgttgagggttagtttaaagatgcttcacttccatattattcttttaaaagaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgagaatgtggtccaacccatgaaggagctatatggaattaacctctcagatggcctctcagaagaagatttctccatttattcaagatttgttcagctggggcagagtcaacataaacaagacaagaatagccagcagccctgttctaggtgctcagatggagttataaaactaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagataatt

SEQ ID NO: 421677 - DNA, 1429 bp, Homo sapiens
tgccgggaggcggggcgcagggatccggaaacacctgatcatctataggtttagtgcctaatgggtgttgttcctggctggacttgatgtccagggcctgaggggttttctcgccgagtctcctggggcggtccggaggctcgtgccctgttgtggggcccccatttgccgccgccatgcccacggccgccgcccccatcatcagctcggtccagaagctggttctgtatgagactagagctagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggggtatttgggatctgtagtgagccttatatgaaatatgtatggaatggtgaacttctggatataattaaaagtactgtgcatcgtgactggcttttgtatattattcatgggttctgtgggcagtcaaagctgttgatctatggacgaccagtgtatgtcactctaatagctagaagatccagtaaatttgctggcacccgttttcttaaaagaggtgcaaactgtgagggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacatgtgtgtggagccatgtttttaataataactcctgtcctcacatttagagataatgaactgttgtcacagaaatctcataaatgcttaggttttcaggaggttttagtcctggaaggtagataatttagaagaggaatttccgttattcttatgtaataaatttatgtttaattttgactgttaaataaattatttttattttgctcagaaatgt

SEQ ID NO: 421678 - DNA, 1199 bp, Homo sapiens
tgccgggaggcggggcgcagggatccggaaacacctgatcatctataggtttagtgcctaatgggtgttgttcctggctggacttgatgtccagggcctgaggggttttctcgccgagtctcctggggcggtccggaggctcgtgccctgttgtggggcccccatttgccgccgccatgcccacggccgccgcccccatcatcagctcggtccagaagctggttctgtatgagactagagctagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcgggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacatgtgtgtggagccatgtttttaataataactcctgtcctcacatttagagataatgaactgttgtcacagaaatctcataaatgcttaggttttcaggaggttttagtcctggaaggtagataatttagaagaggaatttccgttattcttatgtaataaatttatgtttaattttgactgttaaataaattatttttattttgctcagaaatgt

SEQ ID NO: 421679 - DNA, 2150 bp, Homo sapiens
  misc_feature (816)..(816): n is a, c, g, or t
gctaaacccctgtgaatgttcttctaaccttcctgttccccaccccttttctcagatttgacctagaattcccagcccaaatccataatttcttagctctaatacgaattttcatgttggacaaaaacctagctacaaatgggtttctatggaacttctaattaatgtgcaaaatacatattttctccaggttaagaaattttaagtcagatcatgctgacacaataagaaaatttgtttgtgtaattcattgacctcttccttccaaaataacatcaagtagccacctcagtgtgacaatatccagtcaatagtagagaatttaatccttggtcctataaaagaataaaattcattgtcgtatttatagcacgtaagccttgagtaacaggtcttaatgttagtgttggtgttgtggtttctgcggaacgtttacaagtgaagttggattctcctgggctttaaatccaaaaagtcttaatgaccgcttcatgtagttcccctcttattcccctgtggtctcctcagagccagcgtgtgctgggaaagagtattagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaaatatgcttccgggccaaggtcaccgagggggaccttgggatttgtgtcctccccagtgcttagagtagagatacctgcaaattcatggcaaacagttggaaganttacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcactgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaacgtgttggtttttttttattgtaacactctgtgtaaacgttgacaccttattaaatattaaatgtctgaactctatttttaaaaataaaacaagcacagagtctgcaacaaacatgtaaatgga

SEQ ID NO: 421680 - DNA, 713 bp, Homo sapiens
ccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagaaggaaatgtaccaggataagggggtaaaataaccaattaagtgtcaaaggaaagctgctgggttccttaatctcactgaagtcaagtcttctgactgggcttctttccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcaaagtaggaaagtgaaaccgcctatctctgacctgggaggtctgcctgtattctttcccactccaccacactgcacgtggggtgttcccgaaaccaccttcccagatttcctgattctcagtaattttatttatgggacaacatgcatgagtagtcatcatatttttcaagtgaaatatcgggacatgatat

SEQ ID NO: 421681 - DNA, 637 bp, Homo sapiens
ggatgctcttcttttccagtgccttcagtttgttggaggatgcttgattctcacagtgaaacacagggaggaatttctggcccatgtgggtatgtggccaacctttgaaggaactggaaaccaacttaagctcctcagattcaggtctccttcagtagacctaatcagcatctgaagcttgttagcagattcatggttccttaggagccctcactaccctgtcttttgtactctgggcaggctgatctggttgaggaggttaagaagaaaccctggtttgaatagaattaaatgaggtcagcaatgtgggtttgacacgaagcctttgaaagataggctatataaagtcaagatatttctgtcccagaggaaacatatgccaatatatagccacctcccagccccacccaagcttcccctttgtaaaccttcagcaggtaagcactcctgctccccctgttccaagaaactaacgtttaagtacaaagatcacgctttgttgtgtgtgggggtgtttctttttgttgctgtttggaagaattgtgatgtggcataaagactgttgttattgaacccatctctaaataaacagctaaacttaaaatatgctactttttttctggcctttaaagatctt

SEQ ID NO: 421682 - DNA, 1002 bp, Homo sapiens
  misc_feature (22)..(22): n is a, c, g, or t
  misc_feature (32)..(32): n is a, c, g, or t
  misc_feature (941)..(941): n is a, c, g, or t
  misc_feature (943)..(943): n is a, c, g, or t
  misc_feature (951)..(951): n is a, c, g, or t
  misc_feature (954)..(954): n is a, c, g, or t
gcccctaccgcagaagtccggngttaatcggncgagggtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaggtggagatgcgaagattgcattctccactgtcctttgaaccaccaaacaaaaaaaggtagtgggttgactcgtgaaaatttaagcttgaattaaagggattggggatgtttccantnaaaggggnccncatggggggtgggtaaaaactttttaaatgggggcgcgggggcaagtc

SEQ ID NO: 421683 - DNA, 1046 bp, Homo sapiens
  misc_feature (7)..(7): n is a, c, g, or t
  misc_feature (18)..(18): n is a, c, g, or t
  misc_feature (919)..(919): n is a, c, g, or t
tggaagnagacaaactanggctaggtacgaggctgggtttgaatcggccgaggtccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtgaaatttaagccttcgaatccaaagggaattggagaagnccccattagagggctccagcatgcggtggaaacacacctctcaaatgcgggctggagcaaaagatctcaggggcacggaacgacgggggggactgaactgccaccataagagcacgctggggcctag

SEQ ID NO: 421684 - DNA, 946 bp, Homo sapiens
  misc_feature (885)..(885): n is a, c, g, or t
  misc_feature (887)..(887): n is a, c, g, or t
  misc_feature (895)..(895): n is a, c, g, or t
  misc_feature (898)..(898): n is a, c, g, or t
cggacgcgtgggtcgacccacgcgtccggtccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaggtggagatgcgaagattgcattctccactgtcctttgaaccaccaaacaaaaaaaggtagtgggttgactcgtgaaaatttaagcttgaattaaagggattggggatgtttccantnaaaggggnccncatggggggtgggtaaaaactttttaaatgggggcgcgggggcaagtc

SEQ ID NO: 421685 - DNA, 800 bp, Homo sapiens
  misc_feature (1)..(2): n is a, c, g, or t
  misc_feature (28)..(29): n is a, c, g, or t
  misc_feature (31)..(31): n is a, c, g, or t
nnaggctaggtacgaggctgggtggcgnncntatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaggggagagcgagatgcgatctccactgtcatttgaccaccaacaaaaaaagatagcgatggaccgggaaataagcct

SEQ ID NO: 421686 - DNA, 638 bp, Homo sapiens
cagaacaagaaccaaaaacaacaagaggaggaaataacgatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttcctgtctcttgtgttgtttttgtttttttgcttgtttggttctctgtgttttt

SEQ ID NO: 421687 - DNA, 2221 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421688 - DNA, 2046 bp, Homo sapiens
  misc_feature (5)..(5): n is a, c, g, or t
  misc_feature (16)..(17): n is a, c, g, or t
  misc_feature (43)..(43): n is a, c, g, or t
taccncacgcgtcctnncacgctgcagctttcacgaggcatcntggcctactcattagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421689 - DNA, 2285 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacctttatcttctcttcgggtttaagaaacgtttattgtaacagtaattaaatgctgccttaattgaa

SEQ ID NO: 421690 - DNA, 3593 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacctttatcttctcttcgggtttaagaaacgtttattgtaacagtaattaaatgctgccttaattgaaggggttgggtggatttttttttctcaaaataagctgtagggactattttaacagcttaaacaggagctctcaagatgcactttcgtattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccagccccaccctgaacacagctcatacgcagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactgtaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccttctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtga

SEQ ID NO: 421691 - DNA, 4010 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacctttatcttctcttcgggtttaagaaacgtttattgtaacagtaattaaatgctgccttaattgaaggggttgggtggatttttttttctcaaaataagctgtagggactattttaacagcttaaacaggagctctcaagatgcactttcgtattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccagccccaccctgaacacagctcatacgcagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactgtaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccttctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtgatgtcttttatttttcacgttccagatcactcaagttttattttgctggtactttggccacaccctctccttccccatgtggagcaaaagcaacttagggtgcttgacccaaaggctagattcccatgtaagtccccatgtattactgctggttcccgatttctacacctgctggattcattggaggtttgttaaatgtcctgtttttaatttcagcctactcaatttctatgtgggggcagttccaggatgtcctgtaggtgccagatttcatggacactcaagtccctgataaaaaatcgtggtatttgcatataacatacatcctcctgtatactttaaatcatctctatttttcataatatctaatataaatgatatgtaagtgtcatactgtatttagggagtaatgacaaga

SEQ ID NO: 421692 - DNA, 2884 bp, Homo sapiens
  misc_feature (2327)..(2327): n is a, c, g, or t
  misc_feature (2649)..(2649): n is a, c, g, or t
  misc_feature (2884)..(2884): n is a, c, g, or t
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacctttatcttctcttcgggtttaagaaacgtttattgtaacagtaattaaatgctgccttaattgaaaaaaaaaaaaaaaaaaaaaaaaaaaaaaaaaaaaaaaaaaanaaaaaaaaaaaaaaaaaaaagaaaaaaaaaagaaacacaacagaaacaaaacacaacaaaaacagagagggggggcgcgggcgacaaagaaatcccagcgggagcgggaacaacatttgacaccaccccagtttttttttaaagagggggcaccacaatagaggagggggctaaaaaagagcgaggggacgggggagtaaaacaacgcggcggggagagacacacacgcgtgggggcggttgtgagggagaacccccttctgcgggggcgccagtggaaccccccccaggaagataaaagagggcggagggaaaaacaaacnggggggtgtggaggggccaccaggactttttgggtgctgggaatattctctccttctttctttcattgacggcccgtctgcctatccaaaataccacgggtagagagaacgagagaagtgggacagcagagtagaagcagcgaaccatcgcacaaaaacacgagagcacaaacacaacgaccggacgacaaagacgacacagagggaggaaggagaaagacacaatcattaagcn

SEQ ID NO: 421693 - DNA, 2820 bp, Homo sapiens
  misc_feature (2263)..(2263): n is a, c, g, or t
  misc_feature (2585)..(2585): n is a, c, g, or t
  misc_feature (2820)..(2820): n is a, c, g, or t
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacctaaaaaaaaaaaaaaaaaaaaaaaaaaaaaaaaaaaaaaaaanaaaaaaaaaaaaaaaaaaaagaaaaaaaaaagaaacacaacagaaacaaaacacaacaaaaacagagagggggggcgcgggcgacaaagaaatcccagcgggagcgggaacaacatttgacaccaccccagtttttttttaaagagggggcaccacaatagaggagggggctaaaaaagagcgaggggacgggggagtaaaacaacgcggcggggagagacacacacgcgtgggggcggttgtgagggagaacccccttctgcgggggcgccagtggaaccccccccaggaagataaaagagggcggagggaaaaacaaacnggggggtgtggaggggccaccaggactttttgggtgctgggaatattctctccttctttctttcattgacggcccgtctgcctatccaaaataccacgggtagagagaacgagagaagtgggacagcagagtagaagcagcgaaccatcgcacaaaaacacgagagcacaaacacaacgaccggacgacaaagacgacacagagggaggaaggagaaagacacaatcattaagcn

SEQ ID NO: 421694 - DNA, 2283 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacctttaaatacgcctgtttacagtatatgcctttctcctgcggtcgtgcggcgtggtgcggcggc

SEQ ID NO: 421695 - DNA, 1955 bp, Homo sapiens
  misc_feature (7)..(7): n is a, c, g, or t
  misc_feature (18)..(18): n is a, c, g, or t
tggaagnagacaaactanggctaggtacgaggctgggtttgaatcggccgaggcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421696 - DNA, 2248 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggttgtaattacaaccccacgatcacgtaggactttaatcgttgaacaaacgaccttaatagcggctgcaccatcgggatgtcctga

SEQ ID NO: 421697 - DNA, 2275 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaacaaacccaaaaacacgaaaaaaaaaggggggggggaaaaattcctcaggggccagttgggtcccgttttggtaaaggggcccaatgggggggatataaagagggggggcgggttaacgcggacgggaacacgggccgggttttgaagac

SEQ ID NO: 421698 - DNA, 2243 bp, Homo sapiens
  misc_feature (2043)..(2043): n is a, c, g, or t
  misc_feature (2111)..(2111): n is a, c, g, or t
  misc_feature (2119)..(2120): n is a, c, g, or t
  misc_feature (2123)..(2123): n is a, c, g, or t
  misc_feature (2125)..(2125): n is a, c, g, or t
  misc_feature (2131)..(2131): n is a, c, g, or t
  misc_feature (2151)..(2151): n is a, c, g, or t
  misc_feature (2159)..(2159): n is a, c, g, or t
  misc_feature (2215)..(2215): n is a, c, g, or t
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggacngtcctccgtgactgccgtcctccaccttttttacttgttccactccctttctccacacacctttagantgcctttnnctntnaaattntgcgtgtttcggtaccactngtttcacnttcttcaaatgcttttttattccgtggggcttcttttttctacttttttttttttnatttttttttttttttttttttttactt

SEQ ID NO: 421699 - DNA, 2196 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaacaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421700 - DNA, 2230 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacagatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacctttatcttctcttcgggtttaagaaacgtttattgtaacagtaattaaatgctgccttaattgaa

SEQ ID NO: 421701 - DNA, 1913 bp, Homo sapiens
aacataggcaggtacgaggcgggtgttaatcggacgaggtccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421702 - DNA, 1947 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgttgccagggggcattgttgagcacgctgtctagaaacctgttggaaaggccgttttcttgcccccttgttgatggttttgggtgtggctccgtgccggatctgatgg

SEQ ID NO: 421703 - DNA, 1367 bp, Homo sapiens
  misc_feature (1237)..(1237): n is a, c, g, or t
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaatngaagggaatggagagctggttccaattagagatgtgtactgcaatgcaggggttgagaagaggaaatttttgaaagcgggaccggtgaggcgattgtggtgcgaaagggtcggtcagcaaagtgggtgtc

SEQ ID NO: 421704 - DNA, 1782 bp, Homo sapiens
tgtgaggcctccccagctgtgtaaaacctctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421705 - DNA, 1783 bp, Homo sapiens
cggacgcgtgggtcgacccacgcgtccggtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421706 - DNA, 2111 bp, Homo sapiens
atgtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421707 - DNA, 1657 bp, Homo sapiens
  misc_feature (7)..(7): n is a, c, g, or t
  misc_feature (18)..(18): n is a, c, g, or t
tggaagnagacaaactanggctaggtacgaggctgggtttgaatcggccgaggcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421708 - DNA, 1656 bp, Homo sapiens
  misc_feature (18)..(18): n is a, c, g, or t
  misc_feature (24)..(25): n is a, c, g, or t
  misc_feature (31)..(31): n is a, c, g, or t
  misc_feature (45)..(45): n is a, c, g, or t
  misc_feature (78)..(78): n is a, c, g, or t
  misc_feature (116)..(116): n is a, c, g, or t
  misc_feature (121)..(121): n is a, c, g, or t
tttgctaggttagcaccngtctcnntaattngttgaatcatctcntcaaatttctccttttcgtatttctgaagggcnttataatcttcgacagaggtcacatccagcttatgctntgttnttggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421709 - DNA, 1578 bp, Homo sapiens
ggctagtaggaggccgggtgttaattggagatggaacacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421710 - DNA, 1264 bp, Homo sapiens
  misc_feature (1203)..(1203): n is a, c, g, or t
  misc_feature (1205)..(1205): n is a, c, g, or t
  misc_feature (1213)..(1213): n is a, c, g, or t
  misc_feature (1216)..(1216): n is a, c, g, or t
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaggtggagatgcgaagattgcattctccactgtcctttgaaccaccaaacaaaaaaaggtagtgggttgactcgtgaaaatttaagcttgaattaaagggattggggatgtttccantnaaaggggnccncatggggggtgggtaaaaactttttaaatgggggcgcgggggcaagtc

SEQ ID NO: 421711 - DNA, 1360 bp, Homo sapiens
  misc_feature (1)..(2): n is a, c, g, or t
  misc_feature (28)..(29): n is a, c, g, or t
  misc_feature (31)..(31): n is a, c, g, or t
nnaggctaggtacgaggctgggtggcgnncnggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421712 - DNA, 990 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtgtcaacaagttgtaccgccgaatgctgaaattgctggaaatgccgccctactgttgcatatttgaaccggggccgtgccctttggctttttgttgggg

SEQ ID NO: 421713 - DNA, 1168 bp, Homo sapiens
  misc_feature (905)..(905): n is a, c, g, or t
  misc_feature (921)..(921): n is a, c, g, or t
  misc_feature (932)..(932): n is a, c, g, or t
  misc_feature (950)..(950): n is a, c, g, or t
  misc_feature (969)..(969): n is a, c, g, or t
  misc_feature (978)..(978): n is a, c, g, or t
  misc_feature (1030)..(1030): n is a, c, g, or t
  misc_feature (1056)..(1056): n is a, c, g, or t
  misc_feature (1059)..(1059): n is a, c, g, or t
  misc_feature (1061)..(1061): n is a, c, g, or t
  misc_feature (1065)..(1065): n is a, c, g, or t
  misc_feature (1079)..(1079): n is a, c, g, or t
  misc_feature (1084)..(1084): n is a, c, g, or t
  misc_feature (1101)..(1102): n is a, c, g, or t
  misc_feature (1105)..(1105): n is a, c, g, or t
  misc_feature (1147)..(1147): n is a, c, g, or t
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtaccgactggcgcntccaccacgtggatanccacgcttgtnacccgacacgactgtgantgacgacttgcatggtganctgcacgtncctcaccctgtacgcacgactactgcgacgcggacgacgaccgtttgacctnttgacgcattactcaccccgtacgancgngnaccncgtgggggcagggnacggngtgagacggacacctannacntgacttacacggggggtgactctgtgggacaacgagactttnacgtaacccaacacgactgaa

SEQ ID NO: 421714 - DNA, 1398 bp, Homo sapiens
agggggcgtctagaggatccctacacttatcttctcttcgggtttaagaaacgtttattgtaacagtaattaaatgctgccttaattgaaggggttgggtggatttttttttctcaaaataagctgtagggactattttaacagcttaaacaggagctctcaagatgcactttcgtattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccagccccaccctgaacacagctcatacgcagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactgtaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccttctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtga

SEQ ID NO: 421715 - DNA, 686 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcgggagtttgttttttccccccccccccccccggggggggggccgggcgcgggagccggcgtccgccgc

SEQ ID NO: 421716 - DNA, 406 bp, Homo sapiens
gtctcatccaaatactaatggcagtcccaggcaacggtgcctcggtggttctcactgcagcgcagtgcaaggaacatgcaggctgggttcccagagtgagggagggctgcacagatgggagatgagggtatgagcttaggggacgggcgccgggtgatagatctgggcagcaccaaagccccaatcaagacgtccagctcaagagccttgttacctagcaaggtgctttgggttgaactggagatgtctcggtcaaagtggggcagcagttctagtgaacaagttggtcttagatcaagttttgctcatttgtggcccagttttgaaagttaacttcaccagtactgtcttcatccttctccctgaccaccccaattagctgattgccatcgcaacaggagggcgg

SEQ ID NO: 421717 - DNA, 189 bp, Homo sapiens
ccccagactgttgaaaatgcaggttgagatggcattcccctctagaagactcaaaacatcgtttgatttatatctttgagtaacattgtgttatgtggcctgctttggttgcagtaattgtgaaaccaatgaagtttgttttgtggtgttttcctcagggtcaacagttgtcaccgacagatggctgag

SEQ ID NO: 421718 - DNA, 324 bp, Homo sapiens
cgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaaggtgtggtcacttaacagggtatttcatttctgagtgcttttttgcccacccttgaggaaaaatagcgaagagtgaaaaacggacgcacataaccgtaatacaaggtggtgtgcagtgagaaggacagctacggagagggtgcacataagcgtggtgctggaggacagct

SEQ ID NO: 421719 - DNA, 3539 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacctttatcttctcttcgggtttaagaaacgtttattgtaacagtaattaaatgctgccttaattgaaggggttgggtggatttttttttctcaaaataagctgtagggactattttaacagcttaaacaggagctctcaagatgcactttcgtattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccagccccaccctgaacacagctcatacgcagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactgtaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccttctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtga

SEQ ID NO: 421720 - DNA, 1903 bp, Homo sapiens
cggacgcgtgggtcgacccacgcgtccggtccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421721 - DNA, 1340 bp, Homo sapiens
  misc_feature (1213)..(1213): n is a, c, g, or t
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtgaaatttaagccttcgaatccaaagggaattggagaagnccccattagagggctccagcatgcggtggaaacacacctctcaaatgcgggctggagcaaaagatctcaggggcacggaacgacgggggggactgaactgccaccataagagcacgctggggcctag

SEQ ID NO: 421722 - DNA, 2132 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421723 - DNA, 2056 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421724 - DNA, 2190 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421725 - DNA, 2046 bp, Homo sapiens
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421726 - DNA, 700 bp, Homo sapiens
ttagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaaaatagctgtttggtaaccatagtttcacttgttcaaagctgtgtaatcgtgggggtactatctcaactgcttttgtattcattgtattaaaagaatctgtttaaacaacct

SEQ ID NO: 421727 - DNA, 1070 bp, Homo sapiens
  misc_feature (963)..(963): n is a, c, g, or t
  misc_feature (967)..(967): n is a, c, g, or t
  misc_feature (1007)..(1007): n is a, c, g, or t
  misc_feature (1009)..(1009): n is a, c, g, or t
  misc_feature (1052)..(1052): n is a, c, g, or t
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtgtcaaccagttgttcacccgaacagatggcttgaaaattgcctgttgaatgcccgtccctccacttgttancaanaatattggaaccgggaaaaaaacgtttgaactttttgaancnttatccaaaagttaaaaaaggccaaaatttggggccgggcaanggcttgggaaaggaacac

SEQ ID NO: 421728 - DNA, 2310 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421729 - DNA, 2267 bp, Homo sapiens
aagagaggaaggcttaaagagccagactgcgcagccaggactggggtatgggcgctgtcctgcaggccaaagaatgaagatgtagccccgcccccaacctaggaggaggaccagcccggttcctgtcctgcccccgcaacctcgccccgattccactccgggaacctcggcgatgctgagccaagaccacttctgaatcagggatgacttgtctagtgaacgtagggtcagagccatcagttggaaaggctgggaggagcctggagaaagaggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421730 - DNA, 2415 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421731 - DNA, 650 bp, Homo sapiens
cgtagggcaatgcattacattttctacatttatatatgattagttagataacaaataccattgtgttacaattgcctacagtattcagggcagtagcctgctgaacaggtttgttggcttggagcaataggatataccatatactctaggtgtgtgccacctaggtttgtttgtaagtacactctatgatattcacataactaaaattgcctaaggacgcatttctcagactgtatccctgttgtttaaaagacgcataactgtattttagttacttctcatccctatccttcctttcccttccttcctccccaacccctgtttatttcctgggcctggggcttggccatgttcccctccttgtgactagtagagctgggtctttcaagtggcattattgtagagctgctagcaaatattagactacctataaggagaaattggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421732 - DNA, 2147 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421733 - DNA, 1851 bp, Homo sapiens
tgtgtattgattagaggatccccgctacagtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421734 - DNA, 1993 bp, Homo sapiens
gcggaggcaagcgctggcaagtgagtcgccctcaggaacagagggcacctacctggattccagtgcaagctacatcatgtacatggatgagtcatttgctaaccctcagtttgtccatctgtaaaacaggagtaaagattcccttcctaacagggttagagtggggacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421735 - DNA, 1845 bp, Homo sapiens
gtttgaagccaggactgctgggtgtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421736 - DNA, 2222 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421737 - DNA, 2038 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaccatgcatcccgccacaggagttagtcggtctttccctgacgtagttttaccctcaggaatcagctatgagc

SEQ ID NO: 421738 - DNA, 1750 bp, Homo sapiens
ccaaccgtccactgtatagatgaggaaactggaacttctagaggggacgagaagaatgaattagcctaacttagtgctccatccatgtgactggggcaggggaggggtcacttttgtcttcctgagggagacaagagatctctcctttcatgagagacttgggcttgaggctgggttggagaggaaagtctaaaatgtgggggcccaattcacccacccccaaactccctcctcatggtctggtgggatttgctttgcagagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421739 - DNA, 2167 bp, Homo sapiens
cgtagggcaatgcattacattttctacatttatatatgattagttagataacaaataccattgtgttacaattgcctacagtattcagggcagtagcctgctgaacaggtttgttggcttggagcaataggatataccatatactctaggtgtgtgccacctaggtttgtttgtaagtacactctatgatattcacataactaaaattgcctaaggacgcatttctcagactgtatccctgttgtttaaaagacgcataactgtattttagttacttctcatccctatccttcctttcccttccttcctccccaacccctgtttatttcctgggcctggggcttggccatgttcccctccttgtgactagtagagctgggtctttcaagtggcattattgtagagctgctagcaaatattagactacctataaggagaaattgggagccatagagaattttttgagctaggtgggaggccagagttggagaatgggtgtcactgggagctggatgtagggcagaagttttagaggaccgtggaccttgtggggagggcagggcctttctccaagagcttgctagtggctggaggcccatttctaaacttggggaggtggctccatggatcccagagaggcctgtgccaggcgtgggggtaggggaccaaatccgggccagggagttcctgggcacctgacatggttggattccccaggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421740 - DNA, 663 bp, Homo sapiens
ctcggattccgaaacccgcccatgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421741 - DNA, 576 bp, Homo sapiens
tactgaacgccagctgccacctgttattcttataacggaaaaagtgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421742 - DNA, 1870 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgagtctcccgttctctccccctttccccaccacctccatgtgccatggaatcatgagtgactcagactcggtctccacctgccagaagttctcagtcttatgtggataggtttctgcaaactctgatgcctgagtcccaagtgttcggggaaaggataagggagagccaactggtgctcagaggagagagagaagcctccatggagatttgctggagggagtggcacatgagctggggagaaggaactgtcttttatcgagcaactattatgtgccaggtgtggtgcaggtatcattccagctgcttctcacaacagtcctgtgaagttggggttattgttctctctctgcagatgataagactgaagctcattcatccgcacaacaaatatttactgagctgctactatgggccaggtggtgtgccaagtgccagggatcagaggtgaaccaaggagatatgggctctgcccacctggactcagcctaatgagaagccggagacactgagaacaactaattaattattccatttcaatagtaataacagctctgacagagatttgcagtgtctggccctttcatccaggtggtagttcaggcaaggcttaaaccgaggactgaaggataaacagaaattgactgggtgaaaggtgtggggatcgggtaaagggcacggcattccaggcagagggatcagcatgtgccaaggctctgagagaggttaagacatttggcaagttgaggaacagaaggacagctggggtggctggtgcttagggagtgagtgggtaaggagggaaggagggttggcacgaccaggtcttgtgggctgtatgaaggatgttggtttctgctaagagcaccagggagccatgacaagtttttgaacagagggatggcatgatcagatcaggttcaatttatatttttaaaaagataattgttgtaacgttggggcatgtaaaaaaaagggggtagtctgtcagtttatgaaattttgttgta

SEQ ID NO: 421743 - DNA, 855 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggataccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421744 - DNA, 2372 bp, Homo sapiens
aagagaggaaggcttaaagagccagactgcgcagccaggactggggtatgggcgctgtcctgcaggccaaagaatgaagatgtagccccgcccccaacctaggaggaggaccagcccggttcctgtcctgcccccgcaacctcgccccgattccactccgggaacctcggcgatgctgagccaagaccacttctgaatcagggatgacttgtctagtgaacgtagggtcagagccatcagttggaaaggctgggaggagcctggagaaagaggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421745 - DNA, 2836 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggggggccggcgcaatacccccgagcgcgggagggccaccgacagtaaatacgaccacccgcgattatttttttatcaaaaaagaggagcccatcccaatagagaagagcgcgcacttataaattaaaagttgcccggcgagcgagctgccgcccgctataaataatcgacgtctgtgcgggtgaagaaacacacacctgcaccttggtgatataattatcttgtgaaagaaggacccccaccaatctagccggggaggggagagcataaatactgggaccaccccccccccaccccagtgactattataccgtctcggtggcggaacaataacacaacttgatcactatattgaggcaacaacaccccgtacttagtctatcttgccccgaacaaaatctgccccacgcaatattttctacacattttacg

SEQ ID NO: 421746 - DNA, 2256 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421747 - DNA, 2002 bp, Homo sapiens
ctacaaggtcgtggagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggggccttgtacgcgtacagtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421748 - DNA, 1892 bp, Homo sapiens
acggcagggctgggggcttctctccagggagctgctgctgaggcctgtgtctcccgtggctcctctgacagtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421749 - DNA, 1997 bp, Homo sapiens
aagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccataggcagcaacatccgcaacaagtgtagacagtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421750 - DNA, 2331 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagatgcatctggaatatcgtacaggctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421751 - DNA, 1685 bp, Homo sapiens
tgaaattaggaggcccagagaagcgaagtggcccagagtcacagcaaatctccacattcctccaccaaggcccaggccacagttctaacaggatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421752 - DNA, 1315 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagca

SEQ ID NO: 421753 - DNA, 1515 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccgatgataagactgaagctcattcatccgcacaacaaatatttactgagctgctactatgggccaggtggtgtgccaagtgccagggatcagaggtgaaccaaggagatatgggctctgcccacctggactcagcctaatgagaagccggagacactgagaacaactaattaattattccatttcaatagtaataacagctctgacagagatttgcagtgtctggccctttcatccaggtggtagttcaggcaaggcttaaaccgaggactgaaggataaacagaaattgactgggtgaaaggtgtggggatcgggtaaagggcacggcattccaggcagagggatcagcatgtgccaaggctctgagagaggttaagacatttggcaagttgaggaacagaaggacagctggggtggctggtgcttagggagtgagtgggtaaggagggaaggagggttggcacgaccaggtcttgtgggctgtatgaaggatgttggtttctgctaagagcaccagggagccatgacaagtttttgaacagagggatggcatgatcagatcaggttcaatttatatttttaaaaagataattgttgtaacgttggggcatgtaaaaaaaagggggtagtctgtcagtttatgaaattttgttgta

SEQ ID NO: 421754 - DNA, 710 bp, Homo sapiens
ttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgccggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagccgcccctcaccagggccatttcttcaaaaggactttccagagcggagtcagggtaccgagctcg

SEQ ID NO: 421755 - DNA, 769 bp, Homo sapiens
aaaaaaaaaaaaaaaaaaaaaatccctgtttattgggaaggatatgttcgattcttaaatacgccatctgacaaatcagaagatggaaggctaatttatactggcaatatggcccgagcagtgtttggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaacca

SEQ ID NO: 421756 - DNA, 2630 bp, Homo sapiens
  misc_feature (2626)..(2626): n is a, c, g, or t
  misc_feature (2628)..(2628): n is a, c, g, or t
  misc_feature (2630)..(2630): n is a, c, g, or t
atccttagagaggctctcgggagtccgagagagcactgcattctgggatttgtagtttctctggtggataccgtcggcgttgggaccgaggcagccctgcatcctgggacttgtagtttctcgcactgcgtgttaagattttggtggttacagagactgtccgtacctctcatttagggttacgcctggaggtgggagactgctgaggaaagattgaaacgtgggagggcggtttctttgctaacgagatcgtactctttatgaagcagcatctgtccctggtgaaaagttgctgtgcgtgctgaagagccagcacagcaacgactagcgcaatcggctggcctcatttcctctcttcccggtagaattcaatgttaactgaaaactaaccacgtcccccactccacccgcgagggtcctgcctttgcctctgggttagctcagctgtcctggatccggagctcacgcacagaaaatccaggcgcctgccaacaccgttactcagtttttgggaacttctttctcattccacgccccgcttcccacccccccgcgtttcctatggctagaatcattttccgcaaaggaaacagtttttagtgatgtcgtccacgagaaaaaaaaatatttaaccctggcttctgggcattgtcattctcgtacagccctctgcccctccacactgttataaagaagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaaccaaaatgtagtatctaccattcgtgttttagaaaggtatgtgaataaatatgttcatgctagtataagagttctgtgttactgtggttgactctaaactggggatctgatgtcagtagcaaatgggagagttgctttattctttgtgtatggatttttctaagtgtataaatattttccgacattaaaagacattttctctttgaggaagacacagtcataggtggtgcggagctgtggtccacctgctcctgctcctgactcactgctctttgctgttgcctgaggaccaagtctgtcaggaagctggctaggaagccttgcagcagccatggcttttaaacataccagaaaaacacccgtggagtcagaggtggcaattcaccgaattcatatcactctaacgagttgcaacgtaaaatccctggataaggtgtgtgctgacttgatctgaggagcaaaggaaaagaatcagtgaaaggaccagtttgaatgcctaccaagactttgagaatcactacaagaaaaacttacggtgaaggttctaaggcatgggatcgtttccagatgagaatccacaagcgactcattgacttgcgcagtcctcagatagttaagcagattacttccatcagtattgagccaggagttgagatggaagtcaccattgcaaatgcttaagtcaactgttttcataaattgattaccagttgttaaaaaattttcaaaaaaccgcaaaatttcaagaaattcacaaattatgggagcagttttaagtcttctttggttcagaacacaggtttttgcctaacccctggcatgattgcccataagaacatacatgtacagttgaactggtggttagctatacgggaaatggtaagtagtgttgtcttcagtatcttaatttgtttctgcaactgtgcactcctcccttggtgggcaccctatgggtgtaggaaaaccactgttattaaacaggtgaaaaataaaaaatntntn

SEQ ID NO: 421757 - DNA, 1470 bp, Homo sapiens
agctgccagtcaggcgtcccgggctgggcatgcgccacttgtgcggcagtcgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaaccacaaaaaaaaaaaaaaaaaaaaaaaaaaaacacgtgtgtgtgcggcgcgcgccccgctgggcccaccggaagaagagctttttatagacacccattcgcggtgtgggcgcgcgcgggcggcccacgttgggttaggtgtgaaactgtgggcgccatatagcgcgggttcccaagagaagagagaacccgggcgcacaggagaccataggcggcgtggggattctcttcacccaatataaaaagaagcgccgcgcggggggacaccgcggagccgttctcgtgaaaccaaattcccagagaggggcggttcgcggagggggccattagcgcggggtctcttattcaagcggggagttccaaaggaggagcccggaattcaaaatttgccca

SEQ ID NO: 421758 - DNA, 2163 bp, Homo sapiens
  misc_feature (2159)..(2159): n is a, c, g, or t
  misc_feature (2161)..(2161): n is a, c, g, or t
  misc_feature (2163)..(2163): n is a, c, g, or t
atccttagagaggctctcgggagtccgagagagcactgcattctgggatttgtagtttctctggtggataccgtcggcgttgggaccgaggcagccctgcatcctgggacttgtagtttctcgcactgcgtgttaagattttggtggttacagagactgtccgtacctctcatttagggttacgcctggaggctagaatcattttccgcaaaggaaacagtttttagtgatgtcgtccacgagaaaaaaaaatatttaaccctggcttctgggcattgtcattctcgtacagccctctgcccctccacactgttataaagaagatccctgtttattgggaaggatatgttcgattcttaaatacgccatctgacaaatcagaagatggaaggctaatttatactggcaatatggcccgagcagtgtttggctggagtgcagtggcatgatcttggttcaccatactcttcgcctcccatgttcaagcgattctcctggctcagcctcctgctgggattacaggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaaccaaaatgtagtatctaccattcgtgttttagaaaggtatgtgaataaatatgttcatgctagtataagagttctgtgttactgtggttgactctaaactggggatctgatgtcagtagcaaatgggagagttgctttattctttgtgtatggatttttctaagtgtataaatattttccgacattaaaagacattttctctttgaggaagacacagtcataggtggtgcggagctgtggtccacctgctcctgctcctgactcactgctctttgctgttgcctgaggaccaagtctgtcaggaagctggctaggaagccttgcagcagccatggcttttaaacataccagaaaaacacccgtggagtcagaggtggcaattcaccgaattcatatcactctaacgagttgcaacgtaaaatccctggataaggtgtgtgctgacttgatctgaggagcaaaggaaaagaatcagtgaaaggaccagtttgaatgcctaccaagactttgagaatcactacaagaaaaacttacggtgaaggttctaaggcatgggatcgtttccagatgagaatccacaagcgactcattgacttgcgcagtcctcagatagttaagcagattacttccatcagtattgagccaggagttgagatggaagtcaccattgcaaatgcttaagtcaactgttttcataaattgattaccagttgttaaaaaattttcaaaaaaccgcaaaatttcaagaaattcacaaattatgggagcagttttaagtcttctttggttcagaacacaggtttttgcctaacccctggcatgattgcccataagaacatacatgtacagttgaactggtggttagctatacgggaaatggtaagtagtgttgtcttcagtatcttaatttgtttctgcaactgtgcactcctcccttggtgggcaccctatgggtgtaggaaaaccactgttattaaacaggtgaaaaataaaaaatntntn

SEQ ID NO: 421759 - DNA, 1174 bp, Homo sapiens
agctgccagtcaggcgtcccgggctgggcatgcgccacttgtgcggcagtcgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggctggagtgcagtggcatgatcttggttcaccatactcttcgcctcccatgttcaagcgattctcctggctcagcctcctgctgggattacaggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaacca

SEQ ID NO: 421760 - DNA, 521 bp, Homo sapiens
tatgttttttaaccactggttttatttctctggtgatttgctgttttaatcctgggcacttagcctgatagaatttcccatgtttgaatattttatgttagatatactggagtgcttgttaatagagagttttgtttgataatctgctatctgaatcaacttttgtagtacaatattagtaaggatctttaagtaatattaactactttattgtggaactgaggtagggccacttaaaccctaaagcagatttcctgcctggagaggcagtgcattctaatggtcagtagcagggacattgaagtcaaaatatgtaaagtccttaaaacagagcttagaatataataagcactgtatttatggtttgattttgttgtcttgagctgatacagtaagaagaaaaatggaagaattagtgggatagattgattcttttataaaatttaaaagtattgatcctctctctttttttcccatttaggtgtgaaatgtttctcttattctacgagtctgattggcct

SEQ ID NO: 421761 - DNA, 2080 bp, Homo sapiens
  misc_feature (2076)..(2076): n is a, c, g, or t
  misc_feature (2078)..(2078): n is a, c, g, or t
  misc_feature (2080)..(2080): n is a, c, g, or t
agctgccagtcaggcgtcccgggctgggcatgcgccacttgtgcggcagtcgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaaccaaaatgtagtatctaccattcgtgttttagaaaggtatgtgaataaatatgttcatgctagtataagagttctgtgttactgtggttgactctaaactggggatctgatgtcagtagcaaatgggagagttgctttattctttgtgtatggatttttctaagtgtataaatattttccgacattaaaagacattttctctttgaggaagacacagtcataggtggtgcggagctgtggtccacctgctcctgctcctgactcactgctctttgctgttgcctgaggaccaagtctgtcaggaagctggctaggaagccttgcagcagccatggcttttaaacataccagaaaaacacccgtggagtcagaggtggcaattcaccgaattcatatcactctaacgagttgcaacgtaaaatccctggataaggtgtgtgctgacttgatctgaggagcaaaggaaaagaatcagtgaaaggaccagtttgaatgcctaccaagactttgagaatcactacaagaaaaacttacggtgaaggttctaaggcatgggatcgtttccagatgagaatccacaagcgactcattgacttgcgcagtcctcagatagttaagcagattacttccatcagtattgagccaggagttgagatggaagtcaccattgcaaatgcttaagtcaactgttttcataaattgattaccagttgttaaaaaattttcaaaaaaccgcaaaatttcaagaaattcacaaattatgggagcagttttaagtcttctttggttcagaacacaggtttttgcctaacccctggcatgattgcccataagaacatacatgtacagttgaactggtggttagctatacgggaaatggtaagtagtgttgtcttcagtatcttaatttgtttctgcaactgtgcactcctcccttggtgggcaccctatgggtgtaggaaaaccactgttattaaacaggtgaaaaataaaaaatntntn

SEQ ID NO: 421762 - DNA, 1081 bp, Homo sapiens
agctgccagtcaggcgtcccgggctgggcatgcgccacttgtgcggcagtcgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaacca

SEQ ID NO: 421763 - DNA, 2173 bp, Homo sapiens
  misc_feature (2169)..(2169): n is a, c, g, or t
  misc_feature (2171)..(2171): n is a, c, g, or t
  misc_feature (2173)..(2173): n is a, c, g, or t
agctgccagtcaggcgtcccgggctgggcatgcgccacttgtgcggcagtcgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggctggagtgcagtggcatgatcttggttcaccatactcttcgcctcccatgttcaagcgattctcctggctcagcctcctgctgggattacaggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaaccaaaatgtagtatctaccattcgtgttttagaaaggtatgtgaataaatatgttcatgctagtataagagttctgtgttactgtggttgactctaaactggggatctgatgtcagtagcaaatgggagagttgctttattctttgtgtatggatttttctaagtgtataaatattttccgacattaaaagacattttctctttgaggaagacacagtcataggtggtgcggagctgtggtccacctgctcctgctcctgactcactgctctttgctgttgcctgaggaccaagtctgtcaggaagctggctaggaagccttgcagcagccatggcttttaaacataccagaaaaacacccgtggagtcagaggtggcaattcaccgaattcatatcactctaacgagttgcaacgtaaaatccctggataaggtgtgtgctgacttgatctgaggagcaaaggaaaagaatcagtgaaaggaccagtttgaatgcctaccaagactttgagaatcactacaagaaaaacttacggtgaaggttctaaggcatgggatcgtttccagatgagaatccacaagcgactcattgacttgcgcagtcctcagatagttaagcagattacttccatcagtattgagccaggagttgagatggaagtcaccattgcaaatgcttaagtcaactgttttcataaattgattaccagttgttaaaaaattttcaaaaaaccgcaaaatttcaagaaattcacaaattatgggagcagttttaagtcttctttggttcagaacacaggtttttgcctaacccctggcatgattgcccataagaacatacatgtacagttgaactggtggttagctatacgggaaatggtaagtagtgttgtcttcagtatcttaatttgtttctgcaactgtgcactcctcccttggtgggcaccctatgggtgtaggaaaaccactgttattaaacaggtgaaaaataaaaaatntntn

SEQ ID NO: 421764 - DNA, 3059 bp, Homo sapiens
acaaggtctgtttcttttcccttaagaaccacaaaagtgctaattttccctttacaaatgttacataaaatcttgattacaaaactactcaacaacttaatcctaccatccatacaattatatgttccttttcagcaaggtcaaaagccaacgatgtagtccctttgtacactagagattctttacataatagaagttcacagactgaaatatcattgctgcagtctttggagaacagaactggtccatttctgtgaatcctttttgcacggacaagactcaagactggctaggtgaaaactggtggcagggaccccagccctcctgttaactttcaggaccacctacttcatcatcaagtctgagaggctgaggttcggtcagcagcagctccgctttggctctgatcatacagtttttagtaatctttcctgaaaaacactggctttctctggaaaagcttcctcagctggaagctttactccctcctcgacagaaagtgaggattacagatgacatggctcaggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaa

SEQ ID NO: 421765 - DNA, 3481 bp, Homo sapiens
acaaggtctgtttcttttcccttaagaaccacaaaagtgctaattttccctttacaaatgttacataaaatcttgattacaaaactactcaacaacttaatcctaccatccatacaattatatgttccttttcagcaaggtcaaaagccaacgatgtagtccctttgtacactagagattctttacataatagaagttcacagactgaaatatcattgctgcagtctttggagaacagaactggtccatttctgtgaatcctttttgcacggacaagactcaagactggctaggtgaaaactggtggcagggaccccagccctcctgttaactttcaggaccacctacttcatcatcaagtctgagaggctgaggttcggtcagcagcagctccgctttggctctgatcatacagtttttagtaatctttcctgaaaaacactggctttctctggaaaagcttcctcagctggaagctttactccctcctcgacagaaagtgaggattacagatgacatggctcaggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacacctgcggccacagactgcgaccgcgattgcagggaggagcatctgaggtggtcacggggtttgcccagctcacaccaactgcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaa

SEQ ID NO: 421766 - DNA, 2206 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaa

SEQ ID NO: 421767 - DNA, 457 bp, Homo sapiens
  misc_feature (57)..(57): n is a, c, g, or t
acttttttttgctaaaccctcagaaatataaaaaaaaaaaaaagacaggacacaaanaaccataagacaaatgaggtatcagaggaacacttaaaagcactgagaatctttaaatctagtaaatttaatacaaaatatggtaacttcaatattcgttttgtgtttgttttttaaatacaggatgattcaaagccgccttactcctacgcgcagctgatagttcaggcgattacgatggctcccgacaaacagctcaccctgaacgggatttatacacacatcactaaaaattatccctactacaggactgcggacaagggctggcaggtaaatgccttcagtttgttgttaaatagaggctgatggataccgagaagaaagtggagcggctgctgtctggaacacaggcacaggataggaaggtagaagggggggttggagcctcccgtgctgagag

SEQ ID NO: 421768 - DNA, 520 bp, Homo sapiens
gagcagaaggaagcgtggttctggaggagcgtctaggcctgcatgctttactgttgtggaaattcatgtgtctgcataggatttgtgaagtgtggattgtttgagatatttccctttgaccaatgcagttcatatttgaaatgtaggagaaatttaaaacccagcctatccttccctttggcattctcctgtcttcctcatctaatcctgctaatggacagaagttttgaagtttgcagagacagttttcaaaccgcattttaccaagagacactttgaaatctgcaaaatattccctttggtcagctcacacaccaataatttttttttttttttttgagtcagagtctcgctctgttatgccaataattttaaccctttagattatgtaggttttttctctgtgtatctgtgttgtgttggctgtttactggatgtatatgagaatcttgctatttgaaataatttggcagtgggtaggtttgaaatatagaatattaaaaacatagagaagaaatgt

SEQ ID NO: 421769 - DNA, 458 bp, Homo sapiens
taacatttctgtatttgttatccctgtaattaaagccagttgctgaagcacagtaggatgcgtgcactgtgatagactaataggaacaactttttctcttccacagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggtaaaggctttgtagccttgaagcagcccctgggggacagtgtgtagccacagggccctcaatgtcacctgcctgtcactcacctgcctgtccagtgacagccctgccagggcatcggtggggatgtgggcttgattctggtgttgctgctgtgttcttggtattggggctttttgcaagtgtactcgtttagtcattcaacgc

SEQ ID NO: 421770 - DNA, 456 bp, Homo sapiens
gagccaagatcgcgtcactgtactccagcctgggcgacacagcgagactctgtctcaaaaaaaagacaaatgaggtatcagaggaacacttaaaagcactgagaatctttaaatctagtaaatttaatacaaaatatggtaacttcaatattcgttttgtgtttgttttttaaatacaggatgattcaaagccgccttactcctacgcgcagctgatagttcaggcgattacgatggctcccgacaaacagctcaccctgaacgggatttatacacacatcactaaaaattatccctactacaggactgcggacaagggctggcaggtaaatgccttcagtttgttgttaaatagaggctgatggataccgagaagaaagtggagcggctgctgtctggaacacaggcacaggataggaaggtagaagggggggttggagcctcccgtgctgagag

SEQ ID NO: 421771 - DNA, 208 bp, Homo sapiens
tactactactgggttggcggccggtcgacccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaa

SEQ ID NO: 421772 - DNA, 3462 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggc

SEQ ID NO: 421773 - DNA, 2999 bp, Homo sapiens
actccacagctgcgctcagctcagagccagcttcgtgtgcagagcccagcagagatggcggagccacttggcatccaagcaccttgccctgtttgtgtccacctggttctgccgtgagaacccctgggttttaagccgttaggctggtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggc

SEQ ID NO: 421774 - DNA, 1861 bp, Homo sapiens
acaacacacgccacaatgacaacaagcttagtaactatgacagcgtacgattagcaggctgtacggtcggactccggttatgacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggc

SEQ ID NO: 421775 - DNA, 2205 bp, Homo sapiens
tagagatggggtcttaccgtgctgctcaggctggtctcaaactcctaggttcaagtgattctctcgcctctgcctccccaaatgctgggactacaggtgtgagccaccgcgcccagccttctccttgtgtttgaactggagaggacagagtgctatacatgtggtcacggtttttcttcgttgaaagctctaacagtggggtcggtccctgttattaagcctgtgtcactattccctgggccctaaaagtgcacctggctcctgtgacttggggtcctttcccactcctctccccagggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacacctgcggccacagactgcgaccgcgattgcagggaggagcatctgaggtggtcacggggtttgcccagctcacaccaactgcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggc

SEQ ID NO: 421776 - DNA, 2905 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggactagagtgtccgtgtatactcaagaatcagc

SEQ ID NO: 421777 - DNA, 2293 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatggtaagacgtgctggtcggtggctccccgtggctgtgggtactgggagcagagccccttctcactcgtggtttcggttctgactgtaacaattttagcttttgtctgaggcaatgtttgcatttcgaagctgcaggaaatctagtcatgctggggaagtggtcgtggagtcggccgtcacgggattcccgtgggaggacctgcctgaaaagagatgagagtttctaatacattgagagggaaaaatactctcgcctcttgtagatttcctgggtgtggcctggaagcgccggttgccggatgaccgggttactctaga

SEQ ID NO: 421778 - DNA, 2155 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatggtaagacgtgctggtcggtggctccccgtggctgtgggtactgggagcagagccccttctcactcgtggtttcggttctgactgtaacaattttagcttttgtctgaggcaatgtttgcatttcgaagctgcaggaaatctagtcttacggtttcaagtgtcgtaatcctctagagcac

SEQ ID NO: 421779 - DNA, 2790 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacacctgcggccacagactgcgaccgcgattgcagggaggagcatctgaggtggtcacggggtttgcccagctcacaccaactgcaggtcagttcctgcttcgccttcagtagcctgagtcccttcttctttttctttcacgttactagggcagttgttcgctgacgccttaattctggaacacgttccttgcccagattcttggtggctgcttgttcccttctcatcgttcctgctgtgttttccatgcttggtgtagggggaccctcagagcttggtgtagggggagcctcagagcttggtgtagggggagcctcagagcttggtgtagggggagcctcagaggtggcgtcaggacgtgcctgccccaccggttgccctggtgccctcgtcacgccccgggaccgcgcacacgtggggactgtttccagacgcactttctgccctggtgccctcatcacgccccgggaccgcgcaca

SEQ ID NO: 421780 - DNA, 787 bp, Homo sapiens
tgtaggtttctgctttttagggcactaaaacgaggacacatttttatttctcagcaaataaatatatgaattctacgtatttttttatgtttcatagaattcaattcgccacaatctctctctgaatcgttatttcatcaaagtgccgcgttcccaggaagaaccaggcaaaggctcgttctggaggatagacccagcctgtggcatcagtccccactgcggtccacggccaggtgaacaatggtaagacgtgctggtcggtggctccccgtggctgtgggtactgggagcagagccccttctcactcgtggtttcggttctgactgtaacaattttagcttttgtctgaggcaatgtttgcatttcgaagctgcaggaaatctagtcatgctggggaagtggtcgtggagtcggccgtcacgggattcccgtgggaggacctgcctgaaaagagatgagagtttctaatacattgagagggaaaaatactctcgcctcttgtagatttcctgggtgtggcctggaagcggcctgaaacggcgggagccgccgcgtgtcttttcccttggcctcgcgcgccctgtggcctgtggcggtgctatgctgctgagggtgggagagaggctgcttttctgtgcgctttgctctcagagtccgtccgaggccggtgcacagaaaaccgcacggatgttctgacattgacaagtggagacaccagaacctccgcgccgacaccgggttatctaccttcgccctgccctgtggagtgtggaaagggtgggagtc

SEQ ID NO: 421781 - DNA, 627 bp, Homo sapiens
atgattcaaagccgccttactcctacgcgcagctgatagttcaggcgattacgatggctcccgacaaacagctcaccctgaacgggatttatacacacatcactaaaaattatccctactacaggactgcggacaagggctggcaggtaaatgccttcagtttgttgttaaatagaggctgatggataccgagaagaaagtggagcggctgctgtctggaacacaggcacaggataggaaggtagaagggggggttggagcctcccgtgctgagaggaagaggagttgggggccggtgctgccatgctctgcctcaccttctttgtgtggagcagaaggaagcgtggttctggaggagcgtctaggcctgcatgctttactgttgtggaaattcatgtgtctgcataggatttgtgaagtgtggattgtttgagatatttccctttgaccaatgcagttcatatttgaaatgtaggagaaatttaaaacccagcctatccttccctttggcattctcctgtcttcctcatctaatcctgctaatggacagaagttttgaagtttgcagagacagttttcaaaccgcattttaccaaggaacacttagaagacatcttaaccagttgg

SEQ ID NO: 421782 - DNA, 3083 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaa

SEQ ID NO: 421783 - DNA, 3505 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacacctgcggccacagactgcgaccgcgattgcagggaggagcatctgaggtggtcacggggtttgcccagctcacaccaactgcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaa

SEQ ID NO: 421784 - DNA, 1081 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcaggatgattcaaagccgccttactcctacgcgcagctgatagttcaggcgattacgatggctcccgacaaacagctcaccctgaacgggatttatacacacatcactaaaaattatccctactacaggactgcggacaagggctggcaggtaaatgccttcagtttgttgttaaatagaggctgatggataccgagaagaaagtggagcggctgctgtctggaacacaggcacaggataggaaggtagaagggggggttggagcctcccgtgctgagag

SEQ ID NO: 421785 - DNA, 3314 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggc

SEQ ID NO: 421786 - DNA, 2966 bp, Homo sapiens
actccacagctgcgctcagctcagagccagcttcgtgtgcagagcccagcagagatggcggagccacttggcatccaagcaccttgccctgtttgtgtccacctggttctgccgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggc

SEQ ID NO: 421787 - DNA, 3289 bp, Homo sapiens
  misc_feature (3087)..(3087): n is a, c, g, or t
  misc_feature (3191)..(3191): n is a, c, g, or t
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaatccnaaaaatagtatctggaggagaaagaaaatagaatgtcaatacatattttcttttgagaaatgttttatagaaactcttttatgataaaaggtctgctgtagatnaaaatgtagaattaggccaggtgcggtggctcatgcctgtcatcccagcactttgggaggccgagacgggcagatcatgaggtcaggagattgagaac

SEQ ID NO: 421788 - DNA, 2186 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaaggggtccgctgtctgaagggatcctcaggggacagc

SEQ ID NO: 421789 - DNA, 2520 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatggtaagacgtgctggtcggtggctccccgtggctgtgggtactgggagcagagccccttctcactcgtggtttcggttctgactgtaacaattttagcttttgtctgaggcaatgtttgcatttcgaagctgcaggaaatctagtcatgctggggaagtggtcgtggagtcggccgtcacgggattcccgtgggaggacctgcctgaaaagagatgagagtttctaatacattgagagggaaaaatactctcgcctcttgtagatttcctgggtgtggcctggaagcggcctgaaacggcgggagccgccgcgtgtcttttcccttggcctcgcgcgccctgtggcctgtggcggtgctatgctgctgagggtgggagagaggctgcttttctgtgcgctttgctctcagagtccgtccgaggccggtgcacagaaaaccgcacggatgttctgacattgacaagtggagacaccagaacctccgcgccgacaccgggttatctaccttcgccctgccctgtggagtgtggaaagggtgggagtc

SEQ ID NO: 421790 - DNA, 2158 bp, Homo sapiens
gccccccccccacgcctcctcccctcctcccgcccgcgcgtgctcccgcccctcgccgccgctcgctcgctcgccggccggcctccgctcggccccctccctcagctccggtgcgcggcggccgacgacccgcggcctgggcctcggcgcgccaccggcgcccgcgcggagcggcccgggggccctcacgcaggcccatggcggcggcgcggcgcgctctcgggccgggcaccacgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccacagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaa

SEQ ID NO: 421791 - DNA, 1908 bp, Homo sapiens
aagccgaaaaaatgcttaatatgttccagtaagggtattaagtaaaaattaaataaacgtattaagtttaacatattaaattaatttaacatttagactaacattaacatttaaattaataagtgaatatacttaatatattctagtacaggtatgcttggaaatagggcgtttccttttcatgaattgatttcgtacagcacagtggcttataaggaaccagcagtgtttttccctgagtaattatgaacttagtcaagatcagaagctgggttttggggttgagaagagttcatttatttaaataaagtttctatttaaaaacctttttaaaaagttaacatcataaatattctgataatttgcatagtagtaaaaattagaagttgaaattctacctaaagctgtagttgccgtcaattgtgtaacatgtgacaaaggttttcccatatgtcatttcatttgattctcaccacaaccatccaaggttgatgttattctcatttaacattgagttaacgaaagtagttgattcactctcgaagtccctgagtgtgagctcttcatcctagcactgtgaagtggtttgcctgctggggcctaaactcctcattccctttaacaaagcttcactgagtgctgcagttctcaaaatatgtaacagttaacacatttttcaaacaggttaggaagcaattcccatagccatcaatacttaaattcaggagtacttttttgtttgtttgttttgttttgtttttagagacaaggtctctttctgttgtccaggctggagtgtagtggtgtgatcatagctcactgcagcttctgtctcctaggctgaagctatcctcccacctcagcctcctgagaagctggggctacagggatgagccaccatgcccagctaattttttattttgattttttgagataagaggtctcaccatgttgcccaggcctgaggcaatctcctggtttcaagcaatcttcccacctcagcctccttaatgactgggattaaaggcatgagccactgcgcccagcaggaatggttattatattcattgagataaactgtagtatttgctgtttgaagtatttaaacataattggcatattacaatatgtgacactggccttaagattctaatttaaaatgcttaacagacttttagacttatgagtttcagttgaaaggtattttaaaatgttactaagtctgcaaaagtactgaaatgtttcagagaacttggaaagtcaccgtatgtttaatttattatgtttatgagatttaagcacttgggaaggtttatgctaatggggtcaagcatttgcaatgctgcttaaaagaatcatttttttaaatgtataaatgctattaagttgtttaaaggaatttgaattgtaaatgggattgttaaaacaaatttagtctgttcaactcaatgagggcatttcattttctaggaacaaaataccctcttagacattaaaaagccgcatgcctgttccctcagctatagttaactggaccatggtggtacaactgactcaacccttctctaagcagggatttgtaattgggatttataatgaaattcctgatctgggaaaatgggaggctgggaatgctatgtctaggtcatcagcggagaaagttggtttgtagagaatgaacaagaatgaaacctaagtgcaaagaaaataaagattatcctgctttaatagttcagactagaggagagagaaaccatcttagttcctgatgacttcctattgccctattctggttgtacctcttcccccaggggtccatgatatttttggattccctctaacacttgtttgcttagttgactgtgagtggttttctcttatttacaaccaaatgactctgaaaacact

SEQ ID NO: 421792 - DNA, 1678 bp, Homo sapiens
  misc_feature (3)..(3): n is a, c, g, or t
  misc_feature (6)..(6): n is a, c, g, or t
  misc_feature (1493)..(1493): n is a, c, g, or t
  misc_feature (1577)..(1577): n is a, c, g, or t
ggncgnctccggctgctcccattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcctatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcaggtaactactctgtgatcggggctctgtgaaacggttttcctgtttatgacggtgttgttgaaattttgaaaaataccacacaggccgggcgtggtggctcacacctgcactttgggaggcagaggcaggtggatcacctgaggtcaggagttcaagaccagcctgaccancatggtgaaagtccgtctctactaaaaatacaaaagttagccaggcgtggtggcaggcacctgtaatcccagctactctcaggnggctacggcagaagaaccgcttgaggccgaggcagaggttgcagtgagctaagatagtgtcactgcactccagcctggccaacacagcaaaactccgtctc

SEQ ID NO: 421793 - DNA, 816 bp, Homo sapiens
  misc_feature (3)..(3): n is a, c, g, or t
  misc_feature (6)..(6): n is a, c, g, or t
ggncgnctccggctgctcccattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtaagagccacaagttcctctccggctgccgcaggaccccactgccgtgtgccgggctcagcacttgtgccccttatcaagtttagcctgcaaagagagtgagagagaccacccgtcccatcgatattctgggaaactgaggcttggcatccaggaacactcctgagtgactgacaaaatgtattcaagcttggttggctgaccccagacactgatgattgattaaagtttgtagtttgggttttc

SEQ ID NO: 421794 - DNA, 697 bp, Homo sapiens
  misc_feature (512)..(512): n is a, c, g, or t
  misc_feature (596)..(596): n is a, c, g, or t
gtttgtaaagcaactcagatgagtttttaaggtaagcaaccccaggaacaaatatgtggttacagacagaggcgagaggcaggagcagagtgagctttggcctgtccttcaggcttttagtgagttgaggacaaatgtttgggtatttctggtgaaacttgctgacagaggttgagaatgtgcctctggtcttctcttcccttcccgccagtcgtctagcatatgccgcgccgccatccactacgggatcctggatgacaagggaggcctggtggatatcaccaggaacgggaaggtccccttcttcgtgaagtctgagagacacggcgtgcagtccctcaggtaactactctgtgatcggggctctgtgaaacggttttcctgtttatgacggtgttgttgaaattttgaaaaataccacacaggccgggcgtggtggctcacacctgcactttgggaggcagaggcaggtggatcacctgaggtcaggagttcaagaccagcctgaccancatggtgaaagtccgtctctactaaaaatacaaaagttagccaggcgtggtggcaggcacctgtaatcccagctactctcaggnggctacggcagaagaaccgcttgaggccgaggcagaggttgcagtgagctaagatagtgtcactgcactccagcctggccaacacagcaaaactccgtctc

SEQ ID NO: 421795 - DNA, 3820 bp, Homo sapiens
gaggtgactctagaggatttccggtatgactgagcttgtggctgatctactaagtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcccgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcactgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggctgtctttttttttttttttttcccgagaccaagtttcactctgttgcccaaggtagagtgcagtggcgtgatctctgctcattgcaactgccgcctcccgggttcaagcaattctcatgcatcagcctcccaagtacctgggactacaggcgtgagctaccatgcccggctaatttttgtatttttagtagagatggggtttcattatgttggccaggctggtctcgaactccttacctcaggtgatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccat

SEQ ID NO: 421796 - DNA, 3104 bp, Homo sapiens
atcgtgcagaagatcacctttcgtgcgatgatcaccttatcgtgcagaagatcacctcatcgtgcagaacatcacctcatcgtgtagaagatcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcccgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcactgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggctgtctttttttttttttttttcccgagaccaagtttcactctgttgcccaaggtagagtgcagtggcgtgatctctgctcattgcaactgccgcctcccgggttcaagcaattctcatgcatcagcctcccaagtacctgggactacaggcgtgagctaccatgcccggctaatttttgtatttttagtagagatggggtttcattatgttggccaggctggtctcgaactccttacctcaggtgatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccat

SEQ ID NO: 421797 - DNA, 151 bp, Homo sapiens
aaacggctcccattcctgaagaaaaccatgtttggctccaaccgagggtgatgagacccaccaagcccaagaaaacctctgcggtcaactacatgagtgagtctaggccgtcctccgcccctcctgccctcccagccacctccaaagggga

SEQ ID NO: 421798 - DNA, 4566 bp, Homo sapiens
  misc_feature (3)..(3): n is a, c, g, or t
  misc_feature (6)..(6): n is a, c, g, or t
ggncgnctccggctgctcccattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcctatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcccgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcactgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggctgtctttttttttttttttttcccgagaccaagtttcactctgttgcccaaggtagagtgcagtggcgtgatctctgctcattgcaactgccgcctcccgggttcaagcaattctcatgcatcagcctcccaagtacctgggactacaggcgtgagctaccatgcccggctaatttttgtatttttagtagagatggggtttcattatgttggccaggctggtctcgaactccttacctcaggtgatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccat

SEQ ID NO: 421799 - DNA, 4396 bp, Homo sapiens
cggttatccgcctactcggcctccaaaatgctgggataacaggcatgagccattacgcccgcccttttttttgggggacagggtctccctctgtcgcccaggctggagtgcagtggcacgatcttggctcaccgcaacctctgcctcctgggttcaagcgattcgcctgcctcagcctcctgagtagctgggactataggtgcctgccaccacgcccggctaatttttgtttttttagtagagatggggtttcaccatgttggtcaggctggtctcaaactcctgacctcatgatccgcccacctcagcctcccaaaatgctgagatgacaggcgtgagccaccgcaccggcccacttgctttgctttttaagaaaatgtatgtatcttcaatgggttagggactaatatctgcttccccaacccttcacctcgtacctctttagtgccagcaccttatacatccaggccaaatgatatcacccttttgtgccttatccctcgagctgtgacacacaaatgtcatcttttcagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcccgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcactgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggctgtctttttttttttttttttcccgagaccaagtttcactctgttgcccaaggtagagtgcagtggcgtgatctctgctcattgcaactgccgcctcccgggttcaagcaattctcatgcatcagcctcccaagtacctgggactacaggcgtgagctaccatgcccggctaatttttgtatttttagtagagatggggtttcattatgttggccaggctggtctcgaactccttacctcaggtgatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccat

SEQ ID NO: 421800 - DNA, 3375 bp, Homo sapiens
tctcttaagtgcccctacgtggggtacgaggagcctgctgggtcgtagtcccagctctattcaagggcccagggaacccataggccctggtagtctagtggcccattgcacagcctggtagcctgaggcccaggcgtgctgggacctgaccctttcccccttgctcctgttcacagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcccgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcactgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggctgtctttttttttttttttttcccgagaccaagtttcactctgttgcccaaggtagagtgcagtggcgtgatctctgctcattgcaactgccgcctcccgggttcaagcaattctcatgcatcagcctcccaagtacctgggactacaggcgtgagctaccatgcccggctaatttttgtatttttagtagagatggggtttcattatgttggccaggctggtctcgaactccttacctcaggtgatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccat

SEQ ID NO: 421801 - DNA, 1218 bp, Homo sapiens
  misc_feature (3)..(3): n is a, c, g, or t
  misc_feature (6)..(6): n is a, c, g, or t
ggncgnctccggctgctcccattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcctatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatctgctctcaatggct

SEQ ID NO: 421802 - DNA, 4904 bp, Homo sapiens
gatgaacccttgtcaggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaaatcagattgtgtggagattcttaaaaaatgtggagaccagaacaaattccctgaagaccacacagctgaaagtatttgtgagcttctgtcacctacagatgatctgaagaattgtatacctttggatacatacctcaggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtcatggaacatcctttagtattgactgcaatgtctgttcttgttttgctggcaatttggtgtgctctacccgcctttgcctcagtgagcacagttcagaagatgaccgtcgtaccttcacaggtctgccctgtaactgtgcagatcagtttgtccctgtatgtgggcagaatgggcgcacttaccccagtgcctgcattgctcgctgtgtgggcctccaagaccatcagtttgagtttggatcatgcatgtcaaaggatccatgtaatcctaatccctgccaaaaaaaccaaaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtgcttgttgcccattatgtgctgggatgttaagagttttatttgacaaagaaaaactggatactattgctaaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtgttatgcaaaagcaagctgattaaatgacactcatataattatatgttgtaagcaacaggctcactggtcacggatttgtgtctgtgacttttgtgaaagggagaagtgacattgcatcaaagcatcttgcattatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatgatcatgcatgcttctaa

SEQ ID NO: 421803 - DNA, 2281 bp, Homo sapiens
  misc_feature (111)..(111): n is a, c, g, or t
  misc_feature (1469)..(1469): n is a, c, g, or t
  misc_feature (1537)..(1537): n is a, c, g, or t
catgcacacatatgtttattgcagcactattcacagtagcaaagacttagaaccaacccaaatgcccatcagtgacagactgaataaagaaaatgtggcacatctacaccntggaatactatgcagccataaaaaaggatgagttcatgtcctttgcagggacatggatgaagctggaaaccatcattctcagcaaactaacacaagaacagaaaacaaaatactgcatgttctcactcataagtgggagttgaactatgagaacacatggacacagggaggggaacatcacacaccagggcctgtcagggagttgggggctaggggagggatagcattaggagaaatacctaatgtagatgacaggttgatgggttcagcaaaccaccatggcatgtgtatacctatgtaacaaatctgcacattctgcacatgtatcccagaacttaaagtacaataaaaacaaacaaaaaaaacagctaattaagccacttatattctgaaaatgtaggtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtaggttagtatttcattttcctttaccaaaatcagtagaaaatggcattttaattaatgattttaagcctagcaaacgtgtgttatattcttacgtggtataggtttagcatttagaaaatataaaatattatttcatccaacaaatgtgtattgagcattgtgtaccgtatacaaaacattgttctgtatattgagtgctaaaagctctgtgttttggggtgtggaggattagcattggcagggtagtaaatatttaagatgatgcaatagatgaattctatccttatagagatcattaagtaagcttacagtttagaagatgttttgatctgacatctaagggacattctctttattaaattatgaaactttgaactttttattatattggtggataacctgggttagcacttataaccagagttaggtggtagcatattggcattcatcttggtgatacacttagagatgaaaaattaacaatacaaatataggatgtaggaattgcagtctagagacaaaaacaaatggagatacctaagatcatggtagaacacaggtacaatagaaatgtgctttattagagatatttggggtaaaaagggaccccatgttactcggatatcctgaaatgaatataagataccaggcgtaaaacaatctttcctgtggtttctaaattggatggacntttagcaaaaaattttgcctagaatagctcatcagactttggtaattgtcaatcaaactttggcaaantttttaaaagacatgaaggtcgggcgcggtggctcatgcctgtaatcccaacacttcaggaggctgaggcaggggatcacctgagatcaggagtttgagaccagcctggccaatatggtgaaaccctgtctctactaaaaaatatacaaaatttagcggggcgtggtggcacatgcctgtaattccagctacttgagaggctgaggcagaagaatcacttggacctgggaggcagaggttgcagtgagccgtgattgcgccactgcactccagcctgagtgacacagtgaagactccgtctcaaaataaattaattaattaattaaagacatgaaaaagagcgagactctgtctccaaataaataaatgaaagacgtgaaaaatctccaaagaaaattaacaaaaaggcttaaagggaaattaaattaggcttgtaattaaggaaattagattgcttgtagaagttaataaatatatttatgggaaggatgctgagtgtttctttgaatgcccacaaaaaagtttacacctacgtagagtcactagaggttggaatggccgtgttgtcccgaaagagcttcagtaaggaaggcttttccttctctctaaccttgatacagggttttatggtttgctgaaggcttgcattttcatcagatttcatcttcataaaaccttcacaggtgactgtgatcgcccagagtctgtcctcaggggccatcatttctttgcacacatttttcc

SEQ ID NO: 421804 - DNA, 1802 bp, Homo sapiens
gatgaacccttgtcaggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgagtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacattaaaaatcagtaaaccctgtcccccgggggctggcaggcttgaggagagaaattcttgctctacaagaactaaaccaaggatggataggaaactgttaagtgcttattgattgcttcccgcttgctggccttttgagtgcacgccgactccttccgtccaaaagctctctcggtaggagatggggtacagcaggagattgaagtaactcgaattcaaggcagaaatgtccagaggaaatgaagggccatgtatgagtgcacagagggagagaggacatcgacctaggatgagtggaaagtggagtgattccccctagctgtactagacattgaaagatggctaggacgtgtgcatgcaaaagtggtgaagtgcattgcttacagggagacaggcagagacaccttaaaaaaaaaaaaaaaaaaaagcaaagtcagccgggtgcggtaggctctcccctgtaatcccagcactttgggaggtggaggcgggcggatcccttgagcccaggagttcgaggccatcctgcttaacatagtgaaaccccgtttctactaaaaatacaaaaattagccgggcatggtggtgtatgcctgttgttccagctacccgcgaggctgagatacgaggattgctcgag

SEQ ID NO: 421805 - DNA, 3193 bp, Homo sapiens
gatgaacccttgtcaggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatatgtttgaattttttgccaatgagcaattattacttttgtaattaaaaagtcataacaatgagaagagagcctgatatcttttaaaaattagggcctcctgatgaagctgcacctgaaatggctcttcagagtctccgctttgtacatcctggaatccattttcttcacctagaggtgaccagatttataaaaactgactgattgaccaaactgaccaaagactgatttataagatgtcaatgttttgatttacactgtgatattgaaagaggctctgtggcttatgtctgtaatctcagcgctttgtgatgctgaggcaggagaattgcttgaggccaagagtttgagaccagcctgggtaacaaagtgagaacccagctctacaaaaaaataataataataattagctgggtgtggtgacacacccagctcctcaggaggctgatgctggaggatcgcttgagcccaagagttcaaggttgcagtgagccatcatcacttcactgcactccagccagggcaacaaagcaagaccctgcctcggggggaaaaaaaaagatgaaaagaaagaaagacttgttttttgtaactcagtagcagtactgtgtgccttgtttggccaccatctaaatcagaactctaatggcttttgacatcctttggtgtagctgtgtggtcaaaatcagaggatgaagcattgccccaataaccttcatttgttttaaaggcagatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaaggcagagccaaactgatatcttgtcagagttcgctactgtactatttatgttacaacttagattaattagcataagatatataaaagctttatgtggtcctggaatgtaatgaaatattgtgtctggaattggttccttccggtgggttcttggtctcgctgacttcaagagtgaagccacagaccctcgcgtgagtgttacagctcttaaaggtggcatccagagttgtttgttcctcccagtgggttcgtggtctcgctgacttcaggagtgaagccgcagaccttcgcagtgagtgttacagctcatgaaggtagtgccgacccaaagagtgagcagcaacaagatttattgtgaagagtgaaagaacaaagcttccacagcatggaaagggactggagcaggttgccactgctggctcgggtggccagcttttattcccttatttggccccgcccacatctgctgattggtccgttttacagagtgctgattggtctatttttacagagtgctgattgctacctttacaaacctttagctagccagaaaagttctccaagtccccacctgacccagaggcccagccggcttcacctctcaatatggtgtttgtgtttgttgctataaaaattagtcatttctctcatgtcaagaacataatcccttttaggtaattgtttctagcaggaaataattccagtttcatctacaataccttttctaggaatatcaaatacctctcctgtgaggacttcttaggtgtaggatggcctttcatttttgtaaggatggtgctaaagatcccatgattggagacagtggtgaattctggtaatagataccttgtccacctaaagctcctcacctttttgctacactgcaaagtaatagagaatttggtagggcctgtattctgcaaatactgacatataactaagagtagtaatggcttccactacactgccatgttctgtgctaagcagagcatgaca

SEQ ID NO: 421806 - DNA, 4980 bp, Homo sapiens
gatgaacccttgtcaggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagcattcatggattttaccgtctcagctatttgcagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagcctgtcctccgttattttagtgtgcttccttctcttgtctggatttctgcattgccctaggaagtctgccagtatgtgttgatgaaggacaagacaggaaagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaaatcagattgtgtggagattcttaaaaaatgtggagaccagaacaaattccctgaagaccacacagctgaaagtatttgtgagcttctgtcacctacagatgatctgaagaattgtatacctttggatacatacctcaggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtcatggaacatcctttagtattgactgcaatgtctgttcttgttttgctggcaatttggtgtgctctacccgcctttgcctcagtgagcacagttcagaagatgaccgtcgtaccttcacaggtctgccctgtaactgtgcagatcagtttgtccctgtatgtgggcagaatgggcgcacttaccccagtgcctgcattgctcgctgtgtgggcctccaagaccatcagtttgagtttggatcatgcatgtcaaaggatccatgtaatcctaatccctgccaaaaaaaccaaaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtgcttgttgcccattatgtgctgggatgttaagagttttatttgacaaagaaaaactggatactattgctaaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtgttatgcaaaagcaagctgattaaatgacactcatataattatatgttgtaagcaacaggctcactggtcacggatttgtgtctgtgacttttgtgaaagggagaagtgacattgcatcaaagcatcttgcattatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatgatcatgcatgcttctaa

SEQ ID NO: 421807 - DNA, 1851 bp, Homo sapiens
gatgaacccttgtcaggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagcattcatggattttaccgtctcagctatttgcagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagcctgtcctccgttattttagtgtgcttccttctcttgtctggatttctgcattgccctaggaagtctgccagtatgtgttgatgaaggacaagacaggaaagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggtaagacaaattattatacatggaatggaaatattttatcattaattataaataagtgaaatacc

SEQ ID NO: 421808 - DNA, 154 bp, Homo sapiens
ggttgttaatttctgtttatttgtttttcttcaatttacagaatgctcttttcagttgcattagcagaaatgaaagtaagtatatttgtcaatggttgtacaaacagtccaaagatataattagccatctgaagcaatgtgcacagcaggattc

SEQ ID NO: 421809 - DNA, 571 bp, Homo sapiens
gtgaaagttctattacataatctttaatagtgatttagtacctataagacttttatcaagtgtatatctaatgttataaaacaatgtcatagaacagtaccatctctctcagctaatttttgcttgtacaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtgagtcttaagctctgattttgtttttaatatgagattagttatttttactttgtaggaagaatactggatagattctgaccacagagtaaggtctgcatatcagatactccagggcagtattttcaaactatacagagcactaggacttctaaggaagtctttagaagtcccctcaataaggggctaatggctaataataattaatatttattgaattctaatcatgtgctaaacacaaagctaagtct

SEQ ID NO: 421810 - DNA, 474 bp, Homo sapiens
ttggtgaaagttctattacataatctttaatagtgatttagtacctataagacttttatcaagtgtatatctaatgttataaaacaatgtcatagaacagtaccatctctctcagctaatttttgcttgtacaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtgagtcttaagctctgattttgtttttaatatgagattagttatttttactttgtaggaagaatactggatagattctgaccacagagtaaggtctgcatatcagatactccagggcagtattttcaaactatacagagcactaggactt

SEQ ID NO: 421811 - DNA, 407 bp, Homo sapiens
attttgaggccctgctgtctgaaccagttttcttatggacagctgctttgacttttagtagtagccttgaaacatctggcatgctatctctttttattgctacttatgaccaaaacatttaaacattttgtttttaaggtgtgtttaagaagtctgatggctgggttggcttaggctgctgtgaactggctattgccttggagtgtcgacaggcatgcaagcaggtaacactgggtagtcaggctctcaaacatcatggagtgcagtttggttttagctgtgcacatgtcttgggccttgcccacctcctagctttgcagaggtaacccgtaaaaactgcaaatttagcattttttgtatagaccatttccttttagacttgctgtttttttatttatggctgctgc

SEQ ID NO: 421812 - DNA, 497 bp, Homo sapiens
ccctgtctctaaaaaatagtgaagtccaagatgtattaagcaaaaaaaaagtaaatcacagaactaaaaatatagtgtgatatatttttagtttatacctaattgtttcactttatatattttccacagtgtttgaattttttgccaatgagcaattattacttttgtaattaaaaagtcataacaatgagaagagagcctgatatcttttaaaaattagggcctcctgatgaagctgcacctgaaatggctcttcagagtctccgctttgtacatcctggaatccattttcttcacctagaggtgaccagatttataaaaactgactgattgaccaaactgaccaaagactgatttataagatgtcaatgttttgatttacactgtgatattgaaagaggctctgtggcttatgtctgtaatctcagcgctttgtgatgctgaggcaggagaattgcttgaggccaagagtttgagaccagcctgggtaacaaagt

SEQ ID NO: 421813 - DNA, 450 bp, Homo sapiens
aaaagaaagaaagacttgttttttgtaactcagtagcagtactgtgtgccttgtttggccaccatctaaatcagaactctaatggcttttgacatcctttggtgtagctgtgtggtcaaaatcagaggatgaagcattgccccaataaccttcatttgttttaaaggcagatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaaggcagagccaaactga

SEQ ID NO: 421814 - DNA, 5040 bp, Homo sapiens
gatgaacccttgtcaggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagcattcatggattttaccgtctcagctatttgcagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagcctgtcctccgttattttagtgtgcttccttctcttgtctggatttctgcattgccctaggaagtctgccagtatgtgttgatgaaggacaagacaggaaagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaaatcagattgtgtggagattcttaaaaaatgtggagaccagaacaaattccctgaagaccacacagctgaaagtatttgtgagcttctgtcacctacagatgatctgaagaattgtatacctttggatacatacctcaggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtcatggaacatcctttagtattgactgcaatgtctgttcttgttttgctggcaatttggtgtgctctacccgcctttgcctcagtgagcacagttcagaagatgaccgtcgtaccttcacaggtctgccctgtaactgtgcagatcagtttgtccctgtatgtgggcagaatgggcgcacttaccccagtgcctgcattgctcgctgtgtgggcctccaagaccatcagtttgagtttggatcatgcatgtcaaaggatccatgtaatcctaatccctgccaaaaaaaccaaaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtgcttgttgcccattatgtgctgggatgttaagagttttatttgacaaagaaaaactggatactattgctaaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtgttatgcaaaagcaagctgattaaatgacactcatataattatatgttgtaagcaacaggctcactggtcacggatttgtgtctgtgacttttgtgaaagggagaagtgacattgcatcaaagcatcttgcattatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatgatcatgcatgcttctaa

SEQ ID NO: 421815 - DNA, 2466 bp, Homo sapiens
gatgaacccttgtcaggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagcagatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaaggcagagccaaactgatatcttgtcagagttcgctactgtactatttatgttacaacttagattaattagcataagatatataaaagctttatgtggtcctggaatgtaatgaaatattgtgtctggaattggttccttccggtgggttcttggtctcgctgacttcaagagtgaagccacagaccctcgcgtgagtgttacagctcttaaaggtggcatccagagttgtttgttcctcccagtgggttcgtggtctcgctgacttcaggagtgaagccgcagaccttcgcagtgagtgttacagctcatgaaggtagtgccgacccaaagagtgagcagcaacaagatttattgtgaagagtgaaagaacaaagcttccacagcatggaaagggactggagcaggttgccactgctggctcgggtggccagcttttattcccttatttggccccgcccacatctgctgattggtccgttttacagagtgctgattggtctatttttacagagtgctgattgctacctttacaaacctttagctagccagaaaagttctccaagtccccacctgacccagaggcccagccggcttcacctctcaatatggtgtttgtgtttgttgctataaaaattagtcatttctctcatgtcaagaacataatcccttttaggtaattgtttctagcaggaaataattccagtttcatctacaataccttttctaggaatatcaaatacctctcctgtgaggacttcttaggtgtaggatggcctttcatttttgtaaggatggtgctaaagatcccatgattggagacagtggtgaattctggtaatagataccttgtccacctaaagctcctcacctttttgctacactgcaaagtaatagagaatttggtagggcctgtattctgcaaatactgacatataactaagagtagtaatggcttccactacactgccatgttctgtgctaagcagagcatgaca

SEQ ID NO: 421816 - DNA, 1114 bp, Homo sapiens
ggagaaaacaggaacaatagaacaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcagatatttggcataaatctgtactcttcattatagttttggggggagagaagattcagtcagaaaacttattcaaagtacctaagtattataaaggagtcaaaaaggtacaaagagaaaaggtcaagacatttttcaaatgagggaaaactaacaggatttatcactagtaaacctgctctaaaagaattcaagggaagctttttaaaaagaagggaagttatagcagaaggaaacttagaatggcaggaataaagaaggcataatgtatagggtaaatataatagacttctcttgaggttttaaaaattacatttgttatttgaaagaaaaaaattaacgttgttgtatgtgattctctgtagaggatatacagtttttttttgttgttcttgtttctgtttttttaaggtgaagtctctgtcacccaagctgaagtgcagttctgtgatcatggctcactgcagcttcaccctgggttcaggtgatcctcccacttcagcctcttcagtaactgggactacaggcatgtactaccacgtccagctaattttttttttcttttttttttagagatggggtctcactctgttgcccaggctaatgccaaactgctaacctcaagatattaatactatacagtagactataagaaattaagtattgtgtatcatccctagagcgacacagatttttccctaaaaaactacagattattttcaaaagcattaataaattaaggtggaatactaaaaaagattcaggtaacccaggaacgagaaacagaataaaacaatagtaaacctaaattttattttatttcattaatacag

SEQ ID NO: 421817 - DNA, 661 bp, Homo sapiens
tgcccagtcgcggaagagcagctgttttggcgtccgtttgctgcggtaggaacatggcggatcggctcacgcagcttcaggacgctgtgaattcggtgaggaatttcattcgattagcctctgtctttctctttcttgaggtaaagcaagggaggaaaggggcccaagaggcaaaacttgaaagtggggagcggactgagagacagggcttcggcataaagcgctctctcgggaggcgccaccgcgaactcggaggtttgaggccggctgccgggcggtgcttgaaggtgcgggagggagcagactctttcgcttgaggagaccgggaagatcgttcttgtccgggtgaggccgccaggacttgtgggctgcgcggtcctgtcgtgttccctgaggacagttttattttcttgtcagtggtgcttacgggttctctttcttttgggggttgggaggagaagcaggagcttttttctttcctcatcaattttaatccaccaagggagatctcatgctctggatgactgggtttttgtaatgaaatgtcagccgagagtattccttcaccagcgctttcaggttggtgcgggagcgatgctgaggtgaggtgagagattttctttcatcttagctcgttcctttgggcccagagtatccttcc

SEQ ID NO: 421818 - DNA, 592 bp, Homo sapiens
tgcccagtcgcggaagagcagctgttttggcgtccgtttgctgcggtaggaacatggcggatcggctcacgcagcttcaggacgctgtgaattcgagtatgcccagctttttgcagcactgattgcacgaacagcaaaagacattgatgttttgatagattccttacccagtgaagaatctacagctgctttacagacagggtctcgctttgccacacaggctggagtgcaatggcacagtcatagctcactgcaacctcagccttccacatttgccaagagccctgatccaggtgaagtgtgtaaaccttgcacgtggaattcccagcaaagaagctgtagggatcgggatagggcctgggaagtgtctgacttacagaaacccaccatgtcttgttctctgctggagacctctgcttctccatcttgtgaacatccacaggccccctgcaccgtaatcttgccctcttactgttgactcagtcctcatggaagttataaaagaacttgtgtggattagcttgctaaatacatccaagatttgaagaactgaaaacaaaatcagtattaaacctgctttttaaaaatgtaa

SEQ ID NO: 421819 - DNA, 1798 bp, Homo sapiens
  misc_feature (1763)..(1763): n is a, c, g, or t
tgcccagtcgcggaagagcagctgttttggcgtccgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttaggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaccncccctctttttattacgtagaaaacaaccaaacac

SEQ ID NO: 421820 - DNA, 2552 bp, Homo sapiens
tgcccagtcgcggaagagcagctgttttggcgtccgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagataccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttaggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcagatatttggcataaatctgtactcttcattatagttttggggggagagaagattcagtcagaaaacttattcaaagtacctaagtattataaaggagtcaaaaaggtacaaagagaaaaggtcaagacatttttcaaatgagggaaaactaacaggatttatcactagtaaacctgctctaaaagaattcaagggaagctttttaaaaagaagggaagttatagcagaaggaaacttagaatggcaggaataaagaaggcataatgtatagggtaaatataatagacttctcttgaggttttaaaaattacatttgttatttgaaagaaaaaaattaacgttgttgtatgtgattctctgtagaggatatacagtttttttttgttgttcttgtttctgtttttttaaggtgaagtctctgtcacccaagctgaagtgcagttctgtgatcatggctcactgcagcttcaccctgggttcaggtgatcctcccacttcagcctcttcagtaactgggactacaggcatgtactaccacgtccagctaattttttttttcttttttttttagagatggggtctcactctgttgcccaggctaatgccaaactgctaacctcaagatattaatactatacagtagactataagaaattaagtattgtgtatcatccctagagcgacacagatttttccctaaaaaactacagattattttcaaaagcattaataaattaaggtggaatactaaaaaagattcaggtaacccaggaacgagaaacagaataaaacaatagtaaacctaaattttattttatttcattaatacag

SEQ ID NO: 421821 - DNA, 2606 bp, Homo sapiens
tgcccagtcgcggaagagcagctgttttggcgtccgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttaggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcagatatttggcataaatctgtactcttcattatagttttggggggagagaagattcagtcagaaaacttattcaaagtacctaagtattataaaggagtcaaaaaggtacaaagagaaaaggtcaagacatttttcaaatgagggaaaactaacaggatttatcactagtaaacctgctctaaaagaattcaagggaagctttttaaaaagaagggaagttatagcagaaggaaacttagaatggcaggaataaagaaggcataatgtatagggtaaatataatagacttctcttgaggttttaaaaattacatttgttatttgaaagaaaaaaattaacgttgttgtatgtgattctctgtagaggatatacagtttttttttgttgttcttgtttctgtttttttaaggtgaagtctctgtcacccaagctgaagtgcagttctgtgatcatggctcactgcagcttcaccctgggttcaggtgatcctcccacttcagcctcttcagtaactgggactacaggcatgtactaccacgtccagctaattttttttttcttttttttttagagatggggtctcactctgttgcccaggctaatgccaaactgctaacctcaagatattaatactatacagtagactataagaaattaagtattgtgtatcatccctagagcgacacagatttttccctaaaaaactacagattattttcaaaagcattaataaattaaggtggaatactaaaaaagattcaggtaacccaggaacgagaaacagaataaaacaatagtaaacctaaattttattttatttcattaatacag

SEQ ID NO: 421822 - DNA, 1880 bp, Homo sapiens
tgcccagtcgcggaagagcagctgttttggcgtccgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttaggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaacaggcagagtgttctattgttcctgttttctcctgaaacttaaactctgaatagcaacagattgcagcaaatgtagctcagcatattctgaaaaatacagccccaggaaatagctagtt

SEQ ID NO: 421823 - DNA, 530 bp, Homo sapiens
tgcccagtcgcggaagagcagctgttttggcgtccgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggtaagcctctattcctttgagaattttaccagtaatagagaattttgaattaaaggaggtagatttagtaccttttgtctgtgtccatttgtgctgctataacaacatacctgagacagtaatttataaagaacagaaatttattttctcacagttctggagtctgggaagtccaacatggccacactggatgaaggtcaagatgtgggcatgtcgatc

SEQ ID NO: 421824 - DNA, 3527 bp, Homo sapiens
caattatttttcaatgtcagaagttattagagccactggcaaagctcatggttgaatatgacatttttctgcttttccctctaagaagtttttgagaatgttaatgttgaagtatgcaggctggacctaccagcaagtttaacacgttaattaggttaaaaagaatattaaaaggcaataattaaatatttcaattattttgtaattataatggtatcaaataagatgcaaaagaagttgatgcttattggtgcttaagagaattacaatactggttttatgagcatcttttctctgcaacagttaaactgcctcagagtttgtgaattgctgcaattcctggaatggaaacaggaattagggtcactggttgattggcacaggatctttccatcgtttctgctcctgacctctctctcttgcctttccttcccccagacaccctcttggtttccattcctttagttccctctgctttagaacacagattacatgttggaaagaaaaatggattaatggtaaaatttctaaaagctaaattgtacagtggggtctcacttcctagaagaaactattggtaatatttctttctaaaggtaatagtattaattgtatctggttttcttcaaaacttaactataatttccttgtcagggtgctcagtagctcttggtttgactttgggctaagggatgtgaaattttagctccttcccaccacctgtttcccctcactcccacccccagccaatattcttcataagcaaaaattatggttaagctaagctgaatgggttatattcaaagtaagtacagacggcaaataggcagacaaatacaggaatgtctttacaattagcccaccatggactgttttgagtctctgcatggtttccataattcattatgatgtatctttatgctctttcactgctcttctgtgcgttggagtttagcaattcagtgagactggggagtgtctcaagaatggaacctttgccttcaaggttgggtcatcaaaaatccctctaaaggatctaactgtaatgaactgtttttatttttgccattagtgcaagtatcaactggcagcctcaaacagctttagactatgtctcaggtctctcatagttatacttagaactgctctttcttgaagctaaaagaggtttttggagtaaagatctgcttcatgtctgctagcatggtatctgctgttcaacctagtatagagcatgtgaaatgcaactgtcctttaatggaattcagccaaactccaaaaatactgagttgcttctagttatctaaagtagtacagaatcactatcccgatgaagaagtggggtttttcagaagattgtaaactcatttccatggcacagatacaaatcatcgtcaggacttgttagccagtccatgtctcattgataggatgtagcctgccatctgcatagatggtttaacatggtgctgtttttgaaaacttgctgtggaaataaatttgacagaagagtagttatttgtaaagctgtcctagaaagaggttaattcttttggtatatgaatatttctcctccaatccttttaattaggtggttcagcttatcttgtattttctgagtcataactatactctagggccaagacctactataaaatctggggtcctaaccagagagttgtttagatcaatatgatatgctttgccaacatgatctaagaaggtattcattctttctgggtttgagaagagttgacgaaagtgtaagattatactctcatgctaaaataaggtataggctaagtgaaatactgtaaatgggttggttagaattaaagtttagaactctaaatcttatgcttatttttaaagtaaaaagttgcctcactgtcatgaaatcctgttactttcattaaaaaaaaaaatcctgtaaaatggtcaaattggataatgtaagagataatgatggctttgaggcatttcatactttaccagtttacatttggctagcagactggtaaggtttagggttctctccactaatggaaaattaaatgctaaacgtcctaagaattatgttgttttcaaggctttgactcagatttgtactttgatgtatgaaagtgaatatcaaacttgtttatagaaaagactatatagaaaaataagtctgtgttgtgtatagtgatacatgttttatgtttacccaatgcctgtactaaatcttgtgcttggctttgaattatatatgtgtttacctatgacttttttttgaaataaacagaacagtcatctaaaaacataaggttttggaaaggagatgctttttcaattcttaccatctgattaggtggaatgttttatagacttttggtgttgaaaaaaaaaaagtttgataacaatgcattttgcttggaataccccccaatccagaaaagttggtgacttctctccattgtatatatgtacatagttttcattactagattgtaagctcctcaagggcaggaattgttttatctttgttgttcctgcagcacctaatgtaaagtgccttgcacagggtaggtgctcatgacgtgtagaatgagtgagtaacttcctgcctcatcaggatgaaatgtggttcacttcccctgtgttcaacactacaaagctactcctgccagaagagggcagagttctttcttgggtttgaactggcttttttgggttgaaccagatcatcccacatccttagcactacttaaccttcttttcctgaagattacatatcagtgtcctgcgtttttatctaatattagagctgaggttcctaggaaaattttgaagtggggaagattatggagaaaatgaaatggaaatttggggagggtggtttgtcagtataaggccctgtggggtaatcatattttagttattacttgttaaaagggtaacagaacctctgtttctttaccaagtcgctggttggccatttctccaattgatgaactaccattggttttagctctttctcatttgggattcccctcaattgcttacatgattctggtacttagagtctaatagagttgctgtgaatatgtagtgctgtacataatggcagttttgtaaatgtgagataaccttgaatatgttgtggtttgtatacagagccattagtattgttattttggccacttttttattcaaaataaataacataattatttgtaaaaaaaaaaaaaaaaaaaaaacaaaacaaaacacaacaccaaacacacaacaccaacgacacacaaactaccagaaaaacaagaaacaaaccaaacgagaaaaagcaaacaacaacaacaaacagaaacacgcaaacgggggaggacgatggaaagatacacccaccgcgcccacaaccccacgagaccagaccacacccgacgaagagaaagggcaacctcgatcggctcaacaaaaaagaacgtcggccgatcataacgcgtgtagagacgaaaagcaaacgctcgcagaagagactaggtggggga

SEQ ID NO: 421825 - DNA, 3346 bp, Homo sapiens
caattatttttcaatgtcagaagttattagagccactggcaaagctcatggttgaatatgacatttttctgcttttccctctaagaagtttttgagaatgttaatgttgaagtatgcaggctggacctaccagcaagtttaacacgttaattaggttaaaaagaatattaaaaggcaataattaaatatttcaattattttgtaattataatggtatcaaataagatgcaaaagaagttgatgcttattggtgcttaagagaattacaatactggttttatgagcatcttttctctgcaacagttaaactgcctcagagtttgtgaattgctgcaattcctggaatggaaacaggaattagggtcactggttgattggcacaggatctttccatcgtttctgctcctgacctctctctcttgcctttccttcccccagacaccctcttggtttccattcctttagttccctctgctttagaacacagattacatgttggaaagaaaaatggattaatggtaaaatttctaaaagctaaattgtacagtggggtctcacttcctagaagaaactattggtaatatttctttctaaaggtaatagtattaattgtatctggttttcttcaaaacttaactataatttccttgtcagggtgctcagtagctcttggtttgactttgggctaagggatgtgaaattttagctccttcccaccacctgtttcccctcactcccacccccagccaatattcttcataagcaaaaattatggttaagctaagctgaatgggttatattcaaagtaagtacagacggcaaataggcagacaaatacaggaatgtctttacaattagcccaccatggactgttttgagtctctgcatggtttccataattcattatgatgtatctttatgctctttcactgctcttctgtgcgttggagtttagcaattcagtgagactggggagtgtctcaagaatggaacctttgccttcaaggttgggtcatcaaaaatccctctaaaggatctaactgtaatgaactgtttttatttttgccattagtgcaagtatcaactggcagcctcaaacagctttagactatgtctcaggtctctcatagttatacttagaactgctctttcttgaagctaaaagaggtttttggagtaaagatctgcttcatgtctgctagcatggtatctgctgttcaacctagtatagagcatgtgaaatgcaactgtcctttaatggaattcagccaaactccaaaaatactgagttgcttctagttatctaaagtagtacagaatcactatcccgatgaagaagtggggtttttcagaagattgtaaactcatttccatggcacagatacaaatcatcgtcaggacttgttagccagtccatgtctcattgataggatgtagcctgccatctgcatagatggtttaacatggtgctgtttttgaaaacttgctgtggaaataaatttgacagaagagtagttatttgtaaagctgtcctagaaagaggttaattcttttggtatatgaatatttctcctccaatccttttaattaggtggttcagcttatcttgtattttctgagtcataactatactctagggccaagacctactataaaatctggggtcctaaccagagagttgtttagatcaatatgatatgctttgccaacatgatctaagaaggtattcattctttctgggtttgagaagagttgacgaaagtgtaagattatactctcatgctaaaataaggtataggctaagtgaaatactgtaaatgggttggttagaattaaagtttagaactctaaatcttatgcttatttttaaagtaaaaagttgcctcactgtcatgaaatcctgttactttcattaaaaaaaaaaatcctgtaaaatggtcaaattggataatgtaagagataatgatggctttgaggcatttcatactttaccagtttacatttggctagcagactggtaaggtttagggttctctccactaatggaaaattaaatgctaaacgtcctaagaattatgttgttttcaaggctttgactcagatttgtactttgatgtatgaaagtgaatatcaaacttgtttatagaaaagactatatagaaaaataagtctgtgttgtgtatagtgatacatgttttatgtttacccaatgcctgtactaaatcttgtgcttggctttgaattatatatgtgtttacctatgacttttttttgaaataaacagaacagtcatctaaaaacataaggttttggaaaggagatgctttttcaattcttaccatctgattaggtggaatgttttatagacttttggtgttgaaaaaaaaaaagtttgataacaatgcattttgcttggaataccccccaatccagaaaagttggtgacttctctccattgtatatatgtacatagttttcattactagattgtaagctcctcaagggcaggaattgttttatctttgttgttcctgcagcacctaatgtaaagtgccttgcacagggtaggtgctcatgacgtgtagaatgagtgagtaacttcctgcctcatcaggatgaaatgtggttcacttcccctgtgttcaacactacaaagctactcctgccagaagagggcagagttctttcttgggtttgaactggcttttttgggttgaaccagatcatcccacatccttagcactacttaaccttcttttcctgaagattacatatcagtgtcctgcgtttttatctaatattagagctgaggttcctaggaaaattttgaagtggggaagattatggagaaaatgaaatggaaatttggggagggtggtttgtcagtataaggccctgtggggtaatcatattttagttattacttgttaaaagggtaacagaacctctgtttctttaccaagtcgctggttggccatttctccaattgatgaactaccattggttttagctctttctcatttgggattcccctcaattgcttacatgattctggtacttagagtctaatagagttgctgtgaatatgtagtgctgtacataatggcagttttgtaaatgtgagataaccttgaatatgttgtggtttgtatacagagccattagtattgttattttggccacttttttattcttaacataattatctgtaactccttccactccgtccctctctatctcttcacccattcatcttcccttactctcctacgctcctctcttctcacctactctctcttcctcccttcttcatatctatttcccttctccttctcctttattccct

SEQ ID NO: 421826 - DNA, 570 bp, Homo sapiens
ggtatcacattttctctgcctggggttaatttgttcttattattctaggtaagaaattgatagcttgttatgcttggtactcattctgaaatccctgtgtgtccaccaggcagacttcaagcaatctctacctactattatatctgccaaaactaccaattatttttcaatgtcagaagttattagagccactggcaaagctcatggttgaatatgacatttttctgcttttccctctaagaagtttttgagaatgttaatgttgaagtatgcaggctggacctaccagcaagtttaacacgttaattaggttaaaaagaatattaaaaggcaataattaaatatttcaattattttgtaattataatggtatcaaataagatgcaaaagaagttgatgcttattggtgcttaagagaattacaatactggttttatgagcatcttttctctgcaacagttaaactgcctcagagtttgtgaattgctgcaattcctggaatggaaacaggaattagggtcactggttgattggcacaggatctttccatcgtttctgctcctgacctct

SEQ ID NO: 421827 - DNA, 2659 bp, Homo sapiens
gggtagacccacgagtccgcccacgggtctgcatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421828 - DNA, 630 bp, Homo sapiens
  misc_feature (79)..(79): n is a, c, g, or t
gcatttagctgccatgcacctgtccccctttaatactgggcattttaaagccatctcaagaggcatcttctacatgttntgtacgcattaaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421829 - DNA, 3067 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtctgtattaactgcttgggggatcctctagagtcgtaa

SEQ ID NO: 421830 - DNA, 3043 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421831 - DNA, 2420 bp, Homo sapiens
agagggagaaccatgcgggtcccgttccttcttaataaccggtcgcggttattaagaaggactggagaaaggtccggataggcggagatgggaaggaagcagcttaggcagaggctttcagaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421832 - DNA, 2135 bp, Homo sapiens
atgaagccctgccctggggtccagatactgggcatctcctcctagctgtgcactgtccagcctgggcacagtgggcccttcctgaagctattcccaggggatatgctgaactaagttgccacaggacctgcagcctgcccactctcccctaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421833 - DNA, 1070 bp, Homo sapiens
atgttacagtgactcatccccagaactcatacttgattgaatatgccatgatggccaggatctccttctcatgccaggtggagctgagagcatgacgacaggcatcctgacaggtggaaatgaaaagcagcccaagctgctcaggcgagtctcttggggacttgtcagtgctgaaggtggggcaaaagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421834 - DNA, 2389 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgtgtgtggtgtgttgtgggggtgtgtgtgtgtggtgtctatggtgtgtaatgtgtggtgtgggtgtggtgtgtggtatgtggtgtgtgtgatgtgtgtggtgggtgtgtgtagtgtgtgggtgtgtgtggtgtgtggcaggtgtgtggtgg

SEQ ID NO: 421835 - DNA, 1882 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcctggtctgcttccccctgaactgtaattctctgtccatgtttcatgcctatgtctacgcgacctaagcg

SEQ ID NO: 421836 - DNA, 1645 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgacagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgactacctagaatctgcctgaaagggctggagaggggcagtattgggggactgtgcaagctttaccccggcaggacatcacggcatgcttgatgtctggatcagcaat

SEQ ID NO: 421837 - DNA, 827 bp, Homo sapiens
tgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattggtgaggacgtccccttcctggcctcgtacctggggggtgaggaggctgactttccgcggcctcagcatcctgtctcccatggagagaccccatttcctgcctcgggggcccgaagaagcctgcagagggagaaccatgcgggtcccgttccttcttaataaccggtcgcggttattaagaaggactggagaaaggtccggataggcggagatgggaaggaagcagcttaggcagaggctttcaggtagggccaggagtcagaatcaggcttctgtgggggcatctgggctgtttcaagtagagcaacaggacaggtggggcgattgacagtggactgtcttagaaacctcaagtcctggggaaatgcagcccttctttctactcactggcacttacataatatacatgcataggcgttggatacagccgcccacagacaggcacaccttgctgagttggaatcactgcaccataacc

SEQ ID NO: 421838 - DNA, 3062 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421839 - DNA, 3688 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattgggggcccctttggcccaatggattttaaacttggaaaatttttttattggggcccaaattggggcccatttggccaattcccccttaaggggggcgttttaaaattaaagggcccggttttaaaaaacgggggattggaaaaaccctggggttccccaatttaaagcctttggaaaaaaacccctttttccaaggtggggaaaaatcaaaaaggccccccccaaaggccttttccaaaagttgcccccccctaatgtggaagggaaatttgacgggtaaaatttttggaaaaaaccccggaaaatttttggaaaaaaaccttattttttaaccaaaagggcccaatttgggaaaaatcccttataatccaaaaaaatttcccccaataggggttagagggtgtccccatttgggacaaaagccccctttttaaaaacagggtgcctacaacctcaagaggcggaaaacccttttttagggcaggggccccttttggaaacccttaccctaat

SEQ ID NO: 421840 - DNA, 3086 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggttggctagaaggccacggggtgggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421841 - DNA, 3008 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 421842 - DNA, 2054 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctctccttcagacttcaagagcctctggcatctccttcagacttacggaacctctagagta

SEQ ID NO: 421843 - DNA, 1019 bp, Homo sapiens
acttgtcccctcctcgccatcctcgagggcaggaccgtatgaacccctcagattcctccgtggaagaactgtggctccaccagatcccaaaaagcaaggcccgtttcctacaacccccgaaggagggtcgtcctcactccgccgccaacctactagcaccatcaccagaccctcgagggcggtgccgtggacctctccagatctcaaaaggcagattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctgggtaagggtccaatactgttcccatgggacaggtggaataggacattgtggtgttaagagcatgggtgtttgaagcagatgggctgtgagaccttgggcaagtcacttaatctttctgagcc

SEQ ID NO: 421844 - DNA, 2557 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421845 - DNA, 748 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaaggccagattctccaaaaagaaaatattacacagggtcagaaagaaaagtaaagggtcaattttacagaggaggaagaaagcacttcagaaagaagaaagaac

SEQ ID NO: 421846 - DNA, 2411 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccgcagtccaaaagaaattagagct

SEQ ID NO: 421847 - DNA, 2419 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421848 - DNA, 2509 bp, Homo sapiens
gtgagagtggcgcggagggggtggaggtttgtctccgctgtttcatctctatggctgtcagaggtgggcggctttgaccgagaggctgctggagctcgtgtttggacgcttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421849 - DNA, 2196 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagcccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421850 - DNA, 2068 bp, Homo sapiens
gggaaacaaatgggacacctagaaagactttattattttgcttttctgagctaatcaatgactttaatttggaaaagcaactaaatatttggagaaaaccatgaaaagaatatatacttacagacgggccaaggagatcttcaaggacactcctaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421851 - DNA, 1636 bp, Homo sapiens
gatagttgatttcctagaggtatccccctaacaggctttgagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421852 - DNA, 2212 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctccctacccccgcatccacttccctcatggccacaatagtgc

SEQ ID NO: 421853 - DNA, 2432 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421854 - DNA, 1681 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatgcaatggcgaactgagcaataaggaatttgtttcccaattcccccccgcaccaacaacaacagcacaccacacgcagacggtacgcatgcttcttttctcttcgcgtcgcgcgcaggggggagcagcaaaacaaagaaacaccacgcggtgggaccccccccaaaaaaagaaacaaagaaacccacccagaagggggggagaggggcgagcaccacccaccgaggtatattttttggggggcggcgccagacaacaacattttttcggcggcgcaacaacactctccgggacaaaaacccgg

SEQ ID NO: 421855 - DNA, 456 bp, Homo sapiens
gttactcatctagaaggtcaggagtgtggctaaaggcagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421856 - DNA, 1192 bp, Homo sapiens
gggaaacaaatgggacacctagaaagactttattattttgcttttctgagctaatcaatgactttaatttggaaaagcaactaaatatttggagaaaaccatgaaaagaatatatacttacagacgggccaaggagatcttcaaggacactcctaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatgcaatggcgaactgagcaataaggaatttgtttcccaattcccccccgcaccaacaacaacagcacaccacacgcagacggtacgcatgcttcttttctcttcgcgtcgcgcgcaggggggagcagcaaaacaaagaaacaccacgcggtgggaccccccccaaaaaaagaaacaaagaaacccacccagaagggggggagaggggcgagcaccacccaccgaggtatattttttggggggcggcgccagacaacaacattttttcggcggcgcaacaacactctccgggacaaaaacccgg

SEQ ID NO: 421857 - DNA, 2677 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaaggaaagggcaccatcttcatggggagaagatgagtacttgaaatatcaagacaattgcagaaggctgtgccctgagagaatggaagaactgggaaagagaaaaggaagtcagaagcttaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421858 - DNA, 2532 bp, Homo sapiens
cgtaagcttgggccccttgtggatactctagagcggccgctcgcgatctagaacgataggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421859 - DNA, 2190 bp, Homo sapiens
gaaaaagaaaaatacctttaggtgaacactatagatcacacccgggtgaggtttccaattaaagtcagcgtacctcggattaaggtattagtgacagctagaatagatcgactactcagtcaacaaattacgatatttgcacttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421860 - DNA, 1929 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaacagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421861 - DNA, 1697 bp, Homo sapiens
caaaaatatacatgtgaaataaaactcagtattttttggtctccccaccatttccatgtctgaccaccgctactactatgtcctatcataacattccatacatacttaaaaccaagcaaagggtggagttccatctttaaaaactaaacaggcattttggacaacacattcttggcgcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421862 - DNA, 1765 bp, Homo sapiens
gtgagagtggcgcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatgtgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttgga

SEQ ID NO: 421863 - DNA, 1409 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcgagatcggagttctttaattaggaatggaatgcaacagatttggacaagtcaaggacaagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataac

SEQ ID NO: 421864 - DNA, 1296 bp, Homo sapiens
  misc_feature (5)..(9): n is a, c, g, or t
  misc_feature (465)..(465): n is a, c, g, or t
gaatnnnnncagggagaaggcctggaaattatcaccagaccaactcaaaattacaaagttttacaggtgtaagtgtgcattcatctgaagacataagtgattaacttcttttaatctacaactaaggtctgagtcctgaagaccttcctctggagcctcagtaaatttacttaatctaaatgggtccaggtgctggagtgattacccttatcttgtcttctgctaaatcactgaagtttgaggagttcctttagaccttcaataaacttgtttgtagaggcctggagagtttcttcacaaccacagtaaaacttgtttaatcctgaatgggtcctgttaagaattccttcattattctgtcatgctttaaggcccagggaaagcctaggcaaaactcttgataggcttttgttcatcccagcctttgtataagggcactgacttttttagtttttaatatttaangtaaccactcggtcagtactgaaacagttgtgatggaggcctgcattagtgaaacctggcctgccacaggtacatgatattaacttacattttcttcctttgcaagttttatttaagtgacatttgtacaatttttctgtcatggaaattttaccttcagtatttaatagcaaagcatttaaaggagggcatgattttacacaaaaagattatgtaaagggagatatttattggaaagatcaaatatgggcatttcctttttatgcatgatttactcttaatttttgcttctttgtaaatcaataagacactttaatctgattgtttctcattccacagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421865 - DNA, 1606 bp, Homo sapiens
gtgacaagggaaaggagacgatggagccgccatgttgaacacgtctagcctcagttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421866 - DNA, 2019 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctggaatataaagaatggcttatcagtggagaccatcgacagttgagaaaagaagaagcccaaaaagtacaagaatgaaaatcgagagtatccttgaggaatcaccacactgtcttccacaatggttgaactagtttacagtcccaccaacagtgtaaaagtgttcctgtttctccacatcctctccagcacctgttgtttcctgactttttaatgatcgccattctaaccgacatgagttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421867 - DNA, 1863 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagaatagacttttaccctctgtgagatgaatttaaaagtgcctcagaatgcagttgcccttattgtggttgtaatggagaaaatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421868 - DNA, 1702 bp, Homo sapiens
ttcgtactgggcctgagaaggaaggagttattcatctccttaagctttcaggcctcagggagaatcgtacattcccgtctatttggttgtagataaaagggataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggcgccaggtggaggtggattgctaggaggcttccctgttgagctgcagccctgcgggcctggtggagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421869 - DNA, 1729 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaattattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421870 - DNA, 1408 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcgtgagtaccatcttcagctaattctttggtgatgaacaaattaatttgcattaataatatgttaaatttacatgagttccttaagatgctatccaataggaattaggattggattataattattttcctactctgctaacaacaatatacttcatttgaaatacatgctttccaaagaattcaattggttgaacaagaaatttaatcaaaaagggaagcttcagtgctaaaaacaagtcactgcaatcatgtaaag

SEQ ID NO: 421871 - DNA, 1636 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421872 - DNA, 1783 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421873 - DNA, 1099 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagtt

SEQ ID NO: 421874 - DNA, 1869 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctggaatataaagaatggcttatcagtggagaccatcgacagttgagaaaagaagaagcccaaaaagtacaagaatgaaaatcgagagtttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421875 - DNA, 1705 bp, Homo sapiens
gtgacaagggaaaggagacgatggagccgccatgttgaacacgtctagcctcagatatctgtcctgggacaccagtcatctcctgaataacactgtcagctaaaattacacaatttccagcaaaaagaaaaaaaaagattcccacggataaccttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421876 - DNA, 1846 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcgagatcggagttctttaattaggaatggaatgcaacagatttggacaagtcaaggacaaggtattttccagtcatcacttcattgtccctgataggaaaagaaatgttttgctgaaacttaactttgtgtcccttagtgtgttttacttttttattcacctgaaaatcaaataccacctgtgagaagagtgataaacaaagaaaagacccaaaagcctacaatatcacgctgctcaaataagtgtaattgttcagatgttacgacaatgttccatacataaaatattgtgaagatggggagaggaagttttcttgtgaataatatttatagttccacggtcaaatccaatttaaactttgagtaaactttagagtctgtatgactactgactctatttgccaattaataattatatttcagttgttagcattccacgattagctggtttaactatgtttaataagccttctgtcatcttacttttctgttctcttagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataac

SEQ ID NO: 421877 - DNA, 1249 bp, Homo sapiens
tggtgttcctacaagtatttaaatgcaggagcaggaggaattgctggtgccttcattcatgaaaagcatgcccatacgattaaacctgcgagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421878 - DNA, 1745 bp, Homo sapiens
gaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatatatatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacag

SEQ ID NO: 421879 - DNA, 464 bp, Homo sapiens
ctcaattaccttggctgaaggaaagatggcggtaggagagaaaagtgaagaggcgtgagtgtaagaactgggagattccttttccagcaggcctgggtagctgccttcccagcccagccctccctggggcctgcgggagcccttttgcatgcaagggaggatggaggctggcccctctttatagaagcacatttctgccacctcccctgggaggcacccagaagcctgccactctttacctagtcctgcttcctggacgggtggtgggaaggcaggagcctgggtccttaggctgggggcctctctccatccacccacctttccctcattccctctcttggagcagcagccgcccaggcctttagggagggagggtttctggggcccttgggttggagtggggtcgcgttgcattgtgttcatgaccatgtagctcatgttgaaattaaagtttttggcttttc

SEQ ID NO: 421880 - DNA, 3953 bp, Homo sapiens
ctcaattaccttggctgaaggaaagatggcggtaggagagaaaagtgaagaggcgtgagtgtaagaactgggagattccttttccagcaggcctgggtagctgccttcccagcccagccctccctggggcctgcgggagcccttttgcatgcaagggaggatggaggctggcccctctttatagaagcacatttctgccacctcccctgggaggcacccagaagcctgccactctttacctagtccctgctgtgtagggcgtagtccaggttagctaggtagagttagtgctccaagccctggggcctgttcttagctcatgcatagtccttacagagtcccaggaccgggggtggagaggagcctcaagtacattccaggagaccactgtctcctcgctggcctgggcctagatggggcagcctggctcacaggaggccagcccctcctcctccgcccccttccttcccttgtccccgtagggttatagctggagctgcctgttatactcggctgttctgatttattattcttggtactgactttctttatgagggactcctaagggttgtaggaccttggcagagggggcctggtctccattagagggtgttgttttctcctgaggacacccaggctgcctttggtcccaccctgttcctggtcccggtcccggtcccagtcccaccaggcaactccttccacccggaaattcttcccttcccttagcctgtggaaaccctgggtattctttaaagttctggtcaatgtatatcacctccacagagctgcttaccctgcactgggaaggggagatggagacgccccctttacccaggaggtcttcagagtttcctgggaccgcggtgggtggaatcccaaggctgggggtggaaggagcagggctctggagggattcgcattcaaggcacagaattggccccttgcctgtttgtttttctaaccagtgtgatttctctgctgttcgtttattacttaccattggaatattttgagccaggagagcgccttctctctccagccatcaccgctgtggttgttcaggggtagcttttcaaaaacagggcagagcctggctgtcccaaccagggggagcaggggcttggccctgacagcctgagcccttcccctggtgtctgcacagcctttataaagagagagagagctccgaagcaataacaacacctgggggtggtcagtgagggccccctcaatgattttcttgtttgttctgtgaaatcccgctcacctcctggaggggtggagcagctgggggctggagccctgtttctttgtgtcatcgtgagcatgtgccccttcccaggggctgtgaccattgggtgtgggaactacggtctgtcctcaccaagggatgggggtttggggaggagagtgacattttcatcattagcttcggagaagcttcaagcccatcctgtccccgctactgcctggccccttgctgactcaggctgcactgtttgaagaggagcagagaggctggcactaggggccactggggggctggggtctccaggggatgactgttttcaatctctgggccaagatcacatgcaggataccacgggaaggagccatctccactctccttctccagaacccccttgaagggcctttgggaccattagtccatttccattttacagacaaggaaatcaagacccagcttgggggaaaagccacccctggagtcacctgtgtgttcagtggcacccccagcctgggtcccctcctcccaatagaggctgagccggagccagggcagtatgaggtggggctgccactgcccatacctcctcctcccttctttctttgaagcctaatggccccccaaaagatgggcaggacaagctgtagcccatctgagaggttgggaaactgaggcccagaaacaggaagtgactcacacaagacccctcagcaagggtgcaaagggggaagaactaggggctccattgttcttcaggcgacaggagaccgttgctccagtgcatgtctgctgggacaaggattcctggcctcgaagccctgggctgcacagccctactgggctccacctctataaaccagtgacttctctgggcctgggtctgggggagagggttgccagggagactcagctctccttgggggctggcccagctgactgagggtacacaggattgggtctagaccttgatgcctgggtggagggcccttgtaaggggccatagcctcttcaggaccaactggagggagagttaggaaacaccagctcctgcctggggcagtgagggaatgggagcagctgtgggcgcctcatttcaggcaagtcctccccaaaccttcagatgcagtgagacctggccttcctgttgtgcttttcagactttgttttcagaatgcttttatctcgagtgtgcccttcggccctcacaagagcccctggggagtaggtggtggcctgtgccgtcatccccatttcaaagcagggagctgaggtcctgggaggggaaagtgcttgcctgaggtcccactgtgttagtgggtgggcaggactggaactcggttctccaacagcccagagctcactcttttacacccagaggtggagcaggtggcttagggggtggttatgtacttcacaagccaattcccttcagccaggagctcctgggtgcatttccgtgtcagaaacagtaccgagtcccaccccctctggaggcacagctgttgcgtcaggcaaggtcacctgcatttatttattgagcagcagtgctgtgtcaggcccagggaccgagcccctctccctgttcccctatggtgtctccgaggccctctgggagggccccacatctggagcagcacctcagagtggacagaaagcattagcgtccacgagctcacccgacgccgagcctgtgaggtgggctgatggtgcccgtctaacccagcgcttcagggaggtcagaatggagccgaacccagggctgtgagcatcacctctggagccctttcactttatgactgcttcctggacgggtggtgggaaggcaggagcctgggtccttaggctgggggcctctctccatccacccacctttccctcattccctctcttggagcagcagccgcccaggcctttagggagggagggtttctggggcccttgggttggagtggggtcgcgttgcattgtgttcatgaccatgtagctcatgttgaaattaaagtttttggcttttctaacctggctcgttcatgctttgtgttgagacagccctatctgggaagccaggggaagtggctgagtgccacggggtgccaggatgccacacctcgggctttgtctctgcccccttatggtgcaggggcctgttccagaaagtcctgccagagatgcgtaagagggagcagggttctggatgaaccccgtcattctacagatgtggaaactgaggccctgggagaggatgcgattctccaaggtcatattgctggtgattgacaggacccggaagagagctcgtcccatggcattctgctgtgtccaagtggccccagtgacatggtgggtgggtgacagcaaggcctccctcatcctgaagtggggctggccagggacaaagagcatcagctgtctgggggaaagaggccatcattcacacatgggctgattccactctatacactgggcagagaatgagatcgtttagcgcaagagattgacccccttgtcaacactggactgtacacggtcccatttggtccacctttgttccccatgcttctcgtagtgtgagcatctgacctcactaattgcagcgaagattccagtgttgaaagttgcacatttcaaccgttactcagaaaaccagcctcttcacaacagaaaagttgctctggagggtcggctctgaggtggacctgtg

SEQ ID NO: 421881 - DNA, 3267 bp, Homo sapiens
ctcaattaccttggctgaaggaaagatggcggtaggagagaaaagtgaagaggcgtgagtgtaagaactgggagattccttttccagcaggcctgggtagctgccttcccagcccagccctccctggggcctgcgggagcccttttgcatgcaagggaggatggaggctggcccctctttatagaagcacatttctgccacctcccctgggaggcacccagaagcctgccactctttacctagtccctgctgtgtagggcgtagtccaggttagctaggtagagttagtgctccaagccctggggcctgttcttagctcatgcatagtccttacagagtcccaggaccgggggtggagaggagcctcaagtacattccaggagaccactgtctcctcgctggcctgggcctagatggggcagcctggctcacaggaggccagcccctcctcctccgcccccttccttcccttgtccccgtagggttatagctggagctgcctgttatactcggctgttctgatttattattcttggtactgactttctttatgagggactcctaagggttgtaggaccttggcagagggggcctggtctccattagagggtgttgttttctcctgaggacacccaggctgcctttggtcccaccctgttcctggtcccggtcccggtcccagtcccaccaggcaactccttccacccggaaattcttcccttcccttagcctgtggaaaccctgggtattctttaaagttctggtcaatgtatatcacctccacagagctgcttaccctgcactgggaaggggagatggagacgccccctttacccaggaggtcttcagagtttcctgggaccgcggtgggtggaatcccaaggctgggggtggaaggagcagggctctggagggattcgcattcaaggcacagaattggccccttgcctgtttgtttttctaaccagtgtgatttctctgctgttcgtttattacttaccattggaatattttgagccaggagagcgccttctctctccagccatcaccgctgtggttgttcaggggtagcttttcaaaaacagggcagagcctggctgtcccaaccagggggagcaggggcttggccctgacagcctgagcccttcccctggtgtctgcacagcctttataaagagagagagagctccgaagcaataacaacacctgggggtggtcagtgagggccccctcaatgattttcttgtttgttctgtgaaatcccgctcacctcctggaggggtggagcagctgggggctggagccctgtttctttgtgtcatcgtgagcatgtgccccttcccaggggctgtgaccattgggtgtgggaactacggtctgtcctcaccaagggatgggggtttggggaggagagtgacattttcatcattagcttcggagaagcttcaagcccatcctgtccccgctactgcctggccccttgctgactcaggctgcactgtttgaagaggagcagagaggctggcactaggggccactggggggctggggtctccaggggatgactgttttcaatctctgggccaagatcacatgcaggataccacgggaaggagccatctccactctccttctccagaacccccttgaagggcctttgggaccattagtccatttccattttacagacaaggaaatcaagacccagcttgggggaaaagccacccctggagtcacctgtgtgttcagtggcacccccagcctgggtcccctcctcccaatagaggctgagccggagccagggcagtatgaggtggggctgccactgcccatacctcctcctcccttctttctttgaagcctaatggccccccaaaagatgggcaggacaagctgtagcccatctgagaggttgggaaactgaggcccagaaacaggaagtgactcacacaagacccctcagcaagggtgcaaagggggaagaactaggggctccattgttcttcaggcgacaggagaccgttgctccagtgcatgtctgctgggacaaggattcctggcctcgaagccctgggctgcacagccctactgggctccacctctataaaccagtgacttctctgggcctgggtctgggggagagggttgccagggagactcagctctccttgggggctggcccagctgactgagggtacacaggattgggtctagaccttgatgcctgggtggagggcccttgtaaggggccatagcctcttcaggaccaactggagggagagttaggaaacaccagctcctgcctggggcagtgagggaatgggagcagctgtgggcgcctcatttcaggcaagtcctccccaaaccttcagatgcagtgagacctggccttcctgttgtgcttttcagactttgttttcagaatgcttttatctcgagtgtgcccttcggccctcacaagagcccctggggagtaggtggtggcctgtgccgtcatccccatttcaaagcagggagctgaggtcctgggaggggaaagtgcttgcctgaggtcccactgtgttagtgggtgggcaggactggaactcggttctccaacagcccagagctcactcttttacacccagaggtggagcaggtggcttagggggtggttatgtacttcacaagccaattcccttcagccaggagctcctgggtgcatttccgtgtcagaaacagtaccgagtcccaccccctctggaggcacagctgttgcgtcaggcaaggtcacctgcatttatttattgagcagcagtgctgtgtcaggcccagggaccgagcccctctccctgttcccctatggtgtctccgaggccctctgggagggccccacatctggagcagcacctcagagtggacagaaagcattagcgtccacgagctcacccgacgccgagcctgtgaggtgggctgatggtgcccgtctaacccagcgcttcagggaggtcagaatggagccgaacccagggctgtgagcatcacctctggagccctttcactttatgactgcttcctggacgggtggtgggaaggcaggagcctgggtccttaggctgggggcctctctccatccacccacctttccctcattccctctcttggagcagcagccgcccaggcctttagggagggagggtttctggggcccttgggttggagtggggtcgcgttgcattgtgttcatgaccatgtagctcatgttgaaattaaagtttttggcttttc

SEQ ID NO: 421882 - DNA, 778 bp, Homo sapiens
tccgggtagtccaggcggctctcggtggcagtgagcatgcgctccggctccaccacgaacatgtagtagaggttccacatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaataccagtgtgcttttcttggagaaagaagaaaagaagaaagaaggaagaagaagaagaaagaaaggaggaagaaggaagaagaagagccagtgtgataatacattgagtgattttttaaaaagtgcatatatgagcaaaaagttatttttcccttttctgaagtatggcagcatactatatagactgtctctgcatgtttatttttcccccatttaatatatcctggagatcattttatatcaatataaaaatggttttctcattcttttatagctgcagtgtgttccattgtatttatcctcttgcagatgaagaaactaagattccaagggttaagtaagactggtccaagatcacacatctgggaaatagcaaagccatgatatgaacccaaacctgttcattaccttcccttctgccaatttgaggggcagaggtaaagaggagagcaaagaagccacctctaggagggcttgaagcccagaggatgggtcagcc

SEQ ID NO: 421883 - DNA, 229 bp, Homo sapiens
acacacacacacacacacactaggttaacatcaaccaccgcaccatccaggcactcggtggcagtgagcatgcgctccggctccaccacgaacatgtagtagaggttccacatcagcatcgacagcagtggcagaaacgtcaggccgtagccgaagcctcggaaggagcggcccacggcaaaggtcagccagtagatcagccgggagacggcaaagagaccagtgagca

SEQ ID NO: 421884 - DNA, 1952 bp, Homo sapiens
  misc_feature (1623)..(1624): n is a, c, g, or t
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaannaaaaaaaaaaaaaaaaaaaaaaaaaaaaaaacaaaaaaaaaaaaacaacaaaacagagaggggcgggcgcgccccaaaaagaaatcacacccacgcgggggcgccccagactatgccggacccacccgtgttttggtgaaaaggggccccccacaagaggcgggcgctatcaaacaaaccgaagagcgcgcgccacgactacacaccgctgcggcggagacacacgcgcccgcggcactctgggagagagaccccatcccgggggggcgcactggggcaacaccccgcagcgataaagccgcgcaaacaacactccgcgatacggcac

SEQ ID NO: 421885 - DNA, 1828 bp, Homo sapiens
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggctccagtctcttgatgtgtgagtgttgttgggctggtcttgggctggttccagggaatggaagggctaagagatgggcttggaaggcaagtttctgtttgaggctccatttccttgctgtggaaccaaggaacctgccagccctgctccaccaggtagagctgggaggtttctatcgtcatctgaattaaacagggaagggacactcgagactggggg

SEQ ID NO: 421886 - DNA, 1705 bp, Homo sapiens
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaccagtcagaatgccacacatttcccttggatgggacttgcaggcctaaatgagaggcattctgactggttgccttccagggcagccaaccagtcagaatgcctctcatttagggtcgacgc

SEQ ID NO: 421887 - DNA, 2657 bp, Homo sapiens
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctcctgagtagctgagactacgggcgcccgccaccatgcctggctatttttttgtatttttagtagagatggggtttcacccgagatggtctcaatctcctgacctgatgatccgcctgccttggcctcccaaagtgctgggattacaggcgtgagccaccgcgcctggcctattttttttttttttttaaattatagatggggtctctgtcagccaggctggagtgcagtggcagcccccaactcctgagctcaggcagtcctcccaccacagcctaccaaagtgccttggcctcccaaagtgctgagattacaggtgtgagccaccatgcccagcagatttttttcttttatttttttcttaaagaccagtgtgcttttcttggagaaagaagaaaagaagaaagaaggaagaagaagaagaaagaaaggaggaagaaggaagaagaagagccagtgtgataatacattgagtgattttttaaaaagtgcatatatgagcaaaaagttatttttcccttttctgaagtatggcagcatactatatagactgtctctgcatgtttatttttcccccatttaatatatcctggagatcattttatatcaatataaaaatggttttctcattcttttatagctgcagtgtgttccattgtatttatcctcttgcagatgaagaaactaagattccaagggttaagtaagactggtccaagatcacacatctgggaaatagcaaagccatgatatgaacccaaacctgttcattaccttcccttctgccaatttgaggggcagaggtaaagaggagagcaaagaagccacctctaggagggcttgaagcccagaggatgggtcagcc

SEQ ID NO: 421888 - DNA, 1724 bp, Homo sapiens
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccagagacatggtcttgctatgttgccagtctgggctcaaacttctggccttgagtgattctctcacctcagactcctgagtagctgggattacagatgcgggccaccacacctggctgtacaaactttaaaatatgatgaaactgaggcacaaactgcttaatgaacttgtccatggtaaagaagaaaggaccctggataagagaggaaaaggacctggattctagtcctgccactattgccgactgacctgagcaactctcttcccctaatctgttgtgattttccctttgtaaaatgggaagcctggaaaaaa

SEQ ID NO: 421889 - DNA, 1694 bp, Homo sapiens
  misc_feature (1365)..(1366): n is a, c, g, or t
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaannaaaaaaaaaaaaaaaaaaaaaaaaaaaaaaacaaaaaaaaaaaaacaacaaaacagagaggggcgggcgcgccccaaaaagaaatcacacccacgcgggggcgccccagactatgccggacccacccgtgttttggtgaaaaggggccccccacaagaggcgggcgctatcaaacaaaccgaagagcgcgcgccacgactacacaccgctgcggcggagacacacgcgcccgcggcactctgggagagagaccccatcccgggggggcgcactggggcaacaccccgcagcgataaagccgcgcaaacaacactccgcgatacggcac

SEQ ID NO: 421890 - DNA, 1738 bp, Homo sapiens
  misc_feature (1409)..(1410): n is a, c, g, or t
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccagggtgaggaggttgggagagaaccaaggagaagagtgcagaggagagagttcatcccaattagagggtggaactaaagactggggcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaannaaaaaaaaaaaaaaaaaaaaaaaaaaaaaaacaaaaaaaaaaaaacaacaaaacagagaggggcgggcgcgccccaaaaagaaatcacacccacgcgggggcgccccagactatgccggacccacccgtgttttggtgaaaaggggccccccacaagaggcgggcgctatcaaacaaaccgaagagcgcgcgccacgactacacaccgctgcggcggagacacacgcgcccgcggcactctgggagagagaccccatcccgggggggcgcactggggcaacaccccgcagcgataaagccgcgcaaacaacactccgcgatacggcac

SEQ ID NO: 421891 - DNA, 1828 bp, Homo sapiens
  misc_feature (1499)..(1500): n is a, c, g, or t
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagaggagggattgaggccctgcctaggactcaggactcctgctgctagtcacagaataaggctgggagtggcaaggaaaagagggtcgggcacaggttggtcctctttaccctcccttgtttgcctttcttcccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaannaaaaaaaaaaaaaaaaaaaaaaaaaaaaaaacaaaaaaaaaaaaacaacaaaacagagaggggcgggcgcgccccaaaaagaaatcacacccacgcgggggcgccccagactatgccggacccacccgtgttttggtgaaaaggggccccccacaagaggcgggcgctatcaaacaaaccgaagagcgcgcgccacgactacacaccgctgcggcggagacacacgcgcccgcggcactctgggagagagaccccatcccgggggggcgcactggggcaacaccccgcagcgataaagccgcgcaaacaacactccgcgatacggcac

SEQ ID NO: 421892 - DNA, 1428 bp, Homo sapiens
acacacacacacacacacactaggttaacatcaaccaccgcaccatccaggcactcggtggcagtgagcatgcgctccggctccaccacgaacatgtagtagaggttccacatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctcctgagtagctgagactacgggcgcccgccaccatgcctggctatttttttgtatttttagtagagatggggtttcacccgagatggtctcaatctcctgacctgatgatccgcctgccttggcctcccaaagtgctgggattacaggcgtgagccaccgcgcctggcctattttttttttttttttaaattatagatggggtctctgtcagccaggctggagtgcagtggcagcccccaactcctgagctcaggcagtcctcccaccacagcctaccaaagtgccttggcctcccaaagtgctgagattacaggtgtgagccaccatgcccagcagatttttttcttttatttttttcttaaagaccagtgtgcttttcttggagaaagaagaaaagaagaaagaaggaagaagaagaagaaagaaaggaggaagaaggaagaagaagagccagtgtgataatacattgagtgattttttaaaaagtgcatatatgagcaaaaagttatttttcccttttctgaagtatggcagcatactatatagactgtctctgcatgtttatttttcccccatttaatatatcctggagatcattttatatcaatataaaaatggttttctcattcttttatagctgcagtgtgttccattgtatttatcctcttgcagatgaagaaactaagattccaagggttaagtaagactggtccaagatcacacatctgggaaatagcaaagccatgatatgaacccaaacctgttcattaccttcccttctgccaatttgaggggcagaggtaaagaggagagcaaagaagccacctctaggagggcttgaagcccagaggatgggtcagcc

SEQ ID NO: 421893 - DNA, 256 bp, Homo sapiens
acacacacacacacacacactaggttaacatcaaccaccgcaccatccaggcactcggtggcagtgagcatgcgctccggctccaccacgaacatgtagtagaggttccacatcagcatcgacagcagtggcagaaacgtcaggccgtagccgaagcctcggaaggagcggcccacggcaaaggtcagccagtagatcagcctagaattgtttggtctgtggtcaagacctcggggagggaagcggtgcagtaaga

SEQ ID NO: 421894 - DNA, 196 bp, Homo sapiens
agactcagatatgaaagccttggtagggggtgagtgggaggtgtggtctcgggagaaaaactgaggcaagcccagttccaccctacccccaccctccagctgcttgagtttgacagcaccaacgtgtccgatacggcagcaaagcctttgggaagaccatatcctccatactccttggccgatttctcttggaaca

SEQ ID NO: 421895 - DNA, 808 bp, Homo sapiens
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccaggtcaggcttcctggagagaggcagatgggtgaggaatgtaggtgggacaccattgggacctaaaactcattcaaccatttgccatttagcaacactttctttgggtcgtttaagagctaggcactgtgctaatgaatctgacccagtctctgccctcagtggagacagacagaaagtgcaatatgacttacactctggcagatggagatctgcaagggggctaggggccaagagg

SEQ ID NO: 421896 - DNA, 1774 bp, Homo sapiens
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagatccatcattttttcacagggaaaaaacagaccgagggggccggaccaatcgctaaggagcgatcatcacggcgcgttacagtcgagggaacggggtccactaggcgtgaccccttgcgggggaagagagcagagcacacagccccaagaggagagccattgacggaccgcgcctggcggccgagggcggc

SEQ ID NO: 421897 - DNA, 1910 bp, Homo sapiens
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccagaccagtgtgcttttcttggagaaagaagaaaagaagaaagaaggaagaagaagaagaaagaaaggaggaagaaggaagaagaagagccagtgtgataatacattgagtgattttttaaaaagtgcatatatgagcaaaaagttatttttcccttttctgaagtatggcagcatactatatagactgtctctgcatgtttatttttcccccatttaatatatcctggagatcattttatatcaatataaaaatggttttctcattcttttatagctgcagtgtgttccattgtatttatcctcttgcagatgaagaaactaagattccaagggttaagtaagactggtccaagatcacacatctgggaaatagcaaagccatgatatgaacccaaacctgttcattaccttcccttctgccaatttgaggggcagaggtaaagaggagagcaaagaagccacctctaggagggcttgaagcccagaggatgggtcagcc

SEQ ID NO: 421898 - DNA, 1805 bp, Homo sapiens
  misc_feature (1476)..(1477): n is a, c, g, or t
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaannaaaaaaaaaaaaaaaaaaaaaaaaaaaaaaacaaaaaaaaaaaaacaacaaaacagagaggggcgggcgcgccccaaaaagaaatcacacccacgcgggggcgccccagactatgccggacccacccgtgttttggtgaaaaggggccccccacaagaggcgggcgctatcaaacaaaccgaagagcgcgcgccacgactacacaccgctgcggcggagacacacgcgcccgcggcactctgggagagagaccccatcccgggggggcgcactggggcaacaccccgcagcgataaagccgcgcaaacaacactccgcgatacggcac

SEQ ID NO: 421899 - DNA, 1896 bp, Homo sapiens
  misc_feature (1567)..(1568): n is a, c, g, or t
gcgcgatccgtctgtgagtgactgggtggggatgtgcccagccctgctcttggacctatctgtgcatgccatttggctgctggggagaagaccgcaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaannaaaaaaaaaaaaaaaaaaaaaaaaaaaaaaacaaaaaaaaaaaaacaacaaaacagagaggggcgggcgcgccccaaaaagaaatcacacccacgcgggggcgccccagactatgccggacccacccgtgttttggtgaaaaggggccccccacaagaggcgggcgctatcaaacaaaccgaagagcgcgcgccacgactacacaccgctgcggcggagacacacgcgcccgcggcactctgggagagagaccccatcccgggggggcgcactggggcaacaccccgcagcgataaagccgcgcaaacaacactccgcgatacggcac

SEQ ID NO: 421900 - DNA, 1695 bp, Homo sapiens
  misc_feature (1366)..(1367): n is a, c, g, or t
gggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccaggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaannaaaaaaaaaaaaaaaaaaaaaaaaaaaaaaacaaaaaaaaaaaaacaacaaaacagagaggggcgggcgcgccccaaaaagaaatcacacccacgcgggggcgccccagactatgccggacccacccgtgttttggtgaaaaggggccccccacaagaggcgggcgctatcaaacaaaccgaagagcgcgcgccacgactacacaccgctgcggcggagacacacgcgcccgcggcactctgggagagagaccccatcccgggggggcgcactggggcaacaccccgcagcgataaagccgcgcaaacaacactccgcgatacggcac

SEQ ID NO: 421901 - DNA, 193 bp, Homo sapiens
ttttctttttttgactctgattagcaggatgcatttttatttaatctacattatgggcatatgaacattatttgtgacatagttcagagataccacttcattatgaaaaagtttatattaaatgtatatttacacagatgctgattttccttctctataaatgtacttttcattgcaggatgacattttgatt

SEQ ID NO: 421902 - DNA, 882 bp, Homo sapiens
aaaggtaataaacgtatatccaacaaaccaccaaaaaagtgagggctactcatgctcaagtaacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttacgatttgattcttcatacagatcgtaagcaagaccattcttcccaaccaccaccccgatctgatcgcccatccctcttcctccgaacaacccacggcagcaacctaactacattcgcacacgcacatacggaaacatctccctcagaagcgtgcggggcggactctccctcccgaccccgtccccctcgtccctattacccaacccacatatcaacggcactcccttggcaacaacgagagaataagggccacaaggagcatctatccgactccgacaaccattctacccctagaccatcggccaccactcctgaatcagtatcacctattgtttctttacccttatattatccatcctaacacatacaatagtcgaatggatctacctattctcgcctcacccagatagcctcctggactcacgtacctccaccctgcccgccatcaacccatcatacgcaaccccacagagtcactagcccagggaaccccattccgccgacaatcaccgactcgcgcccctctctagacaactaagtgataacccccacctttcccatcac

SEQ ID NO: 421903 - DNA, 3159 bp, Homo sapiens
aggcaccggggctgcgcgcgcagcggagctcgaaggtcttgtcccccgggggcggtcagcctgggccttggcggccaaggggaaacttgggagcctcgggactgttggccaccggcccgtgggaggagtaaaggcggccctggctggcaggccgagggtgtgacgcgccggcccgccctcctcgcgcagcctccggctaggcggcgaggccgcaggccgcgcccgctccttcagccccgccgccggggaggggtttcccgggacgatccggcccctttcatccaggaagtgaaatcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacacatcatataatacattgtattttttacattcattgatattctgtctaatctttattaggcactaatataattctaatggatttgagtttgtttgtatatttaggcctgctggtgaagacacaaatgaagcataatttttgttgcctgtgagcttagaatggtgtgacctatttcattttatttcaatttatcttgtaagtttatgtgggatattttaaaataattaatatttggtatttgtttaaaaaactgtaattataggccttccatcttaagtttaagatggacataaacagtctatacattaatatgtgtttgggtaaactgtatgctacttgaagtgtttgtaattttaaataacacacaggtcatcagactactctatattcagtg

SEQ ID NO: 421904 - DNA, 2814 bp, Homo sapiens
aggcaccggggctgcgcgcgcagcggagctcgaaggtcttgtcccccgggggcggtcagcctgggccttggcggccaaggggaaacttgggagcctcgggactgttggccaccggcccgtgggaggagtaaaggcggccctggctggcaggccgagggtgtgacgcgccggcccgccctcctcgcgcagcctccggctaggcggcgaggccgcaggccgcgcccgctccttcagccccgccgccggggaggggtttcccgggacgatccggcccctttcatccaggaagtgaaatcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaaggtgacaactttggaggggaccacccttgattggatgcataaattctgttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacac

SEQ ID NO: 421905 - DNA, 2304 bp, Homo sapiens
gtaatgttcgggcccaatcctattgtaccctgacattacaatctaacctatgtatgaatgactttaaaagtgatcaccttaataactaacccactaggcgaaaatcctttcttgcccaacaaaggcgcccccgtccggatacaatgccctgcccttagcgggggtgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacac

SEQ ID NO: 421906 - DNA, 1838 bp, Homo sapiens
atccaccctccttggcctcccaaggtgctgggattgcaggcttgagccaccgtggccggccttttaataagatccttttttgtagggaatttgggtttcctttttttaaaaaataaataaataaaaatttcataaatgagactccacgtacacgggacgttgagcataaaaataattcttttttcacttaaagagaagtcatttaaaattccagttgagtgtgtttttgtttatgtaaggccttacaatttaatgctttttacttaatttgcaggagtagccactctataaaagaaccagtatctacacttcaccgactctcccagcgacgccgaagaacctactcagatacagattcttgtagtgatattcctcttgaagacccagataatgtgggtggagaaatgaaggaaagaaaccgggaaggggaagggagaaagaaactttcttgggccaatcaagcaagacctggaagagaagaggaggagaggaggagggttaaagaggttgagtatgtgaaaaaagttatctgaggcaggacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacac

SEQ ID NO: 421907 - DNA, 388 bp, Homo sapiens
actttggaggggaccacccttgattggatgcataaattctggtatgtttaaaaatgagtcatcttattttagtttcatcttgtagcaacatcattagaaattagagcattgctttcttttaaagtaggtattggtgctttcactagtattggcaagtagcaaggaagagttactcttatagctttaggagttcagtagttttaccctagcctagaaatcttttgcattcataattgattgttgcatggttgtatgtttcagtgtctgcaactaagaatgacccatataagtagaataataagatagcaacatttctgtggcacttacttgccataatacactaaacatctggtcaatatttatagcaattaattatttaagttggggc

SEQ ID NO: 421908 - DNA, 2767 bp, Homo sapiens
aggcaccggggctgcgcgcgcagcggagctcgaaggtcttgtcccccgggggcggtcagcctgggccttggcggccaaggggaaacttgggagcctcgggactgttggccaccggcccgtgggaggagtaaaggcggccctggctggcaggccgagggtgtgacgcgccggcccgccctcctcgcgcagcctccggctaggcggcgaggccgcaggccgcgcccgctccttcagccccgccgccggggaggggtttcccgggacgatccggcccctttcatccaggaagtgaaatcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacac

SEQ ID NO: 421909 - DNA, 2915 bp, Homo sapiens
aggcaccggggctgcgcgcgcagcggagctcgaaggtcttgtcccccgggggcggtcagcctgggccttggcggccaaggggaaacttgggagcctcgggactgttggccaccggcccgtgggaggagtaaaggcggccctggctggcaggccgagggtgtgacgcgccggcccgccctcctcgcgcagcctccggctaggcggcgaggccgcaggccgcgcccgctccttcagccccgccgccggggaggggtttcccgggacgatccggcccctttcatccaggaagtgaaatcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagataatgtgggtggagaaatgaaggaaagaaaccgggaaggggaagggagaaagaaactttcttgggccaatcaagcaagacctggaagagaagaggaggagaggaggagggttaaagaggttgagtatgtgaaaaaagttatctgaggcaggacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacac

SEQ ID NO: 421910 - DNA, 2301 bp, Homo sapiens
  misc_feature (15)..(15): n is a, c, g, or t
  misc_feature (41)..(41): n is a, c, g, or t
ttacccgggaatganggggtcagcgccttgtggacaccaancgcactcgtttaagtagagggggctgtgagccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacac

SEQ ID NO: 421911 - DNA, 2235 bp, Homo sapiens
cggccgcgacaacggcaaaaatgcgcccgcgaccggcctcctgctcgcgcttccgcagcccggctgctccctccggcgccccggcgctgcctctttgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacac

SEQ ID NO: 421912 - DNA, 2352 bp, Homo sapiens
ccaataggcggctctccggctgctaagccgagagggcaggggcgccgtcagtagcaccaccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctgagccgagagcaggtgcgccaggtggaggccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtcagtcaccacgaacaggggcactcggcatgctgccccagcactggagaagcagcgctgtgggggcaatctgtcacactctcagagtctgggacttgacttgctaccaacaactgctgtgcaattctgctgagcaggaatatcatgagctgttcaataatgacggacgcattggttgagatgaagtttccagtaaggaagtgacagtgcaatgtggatatttatggctgtaaaataggaagagctttagttcccaggctgaacctgccactgctggagccatttcaacaaggcatcctcacaacaaagaagagatgtgatttggtaccatttcacaccagcaggtgtctggacgaaaacatcaatgtgaataagggccaagtgcagtcctgtcttgattaaattacttaataatattattaaataataataggtctgggcagtattgtttttaacctgactcatccagctgtccttcaaatagctccgtctccctctacccagaactgatttttaaaaagaagtaatttttctccctgggctgggaaaaccctaatgaactgaaacacacttttactttaaaatttttctgtctggcgtttttgtaatcatactattaaatgactctggagtcatgttaatga

SEQ ID NO: 421913 - DNA, 1008 bp, Homo sapiens
agtcaaagcaatgcgcacgcgcagtggctttgaaggcggggcaacaaagcctgtggccgatgtggcgctcctcggcccgcgcttcagtggttatgacagtgttcgctctaaggggagaaggaatgtgtgaccatttccaacggttaacttgcattccccagatagtttggatgagttacaacctaaatctgcaaactcaatacagccagaccctgggaagtgactctctccaagcctcctgtacaagtcccaggaaaagagcctgttttcccttggacatgtgagcagtgaattactgctcattcagaatttcatgtgtatgtgttactgatggccaggtttagagataccaacctatttatttctagaggagaggtgatttgataaccttttcagatatcactatcagtaggcagaaaagggttaatagtatgatagggttaatatgtcctgaggagagtaaagaaattgcaaactgcagaagcacctgatctgtggccctggccagcatctctccatatcctgattctgtaagatcaagtgtttatgcagaaagagaagggactgatgatttgaatgtgaccagatgcagggcatgcccttattgccatgccagcatttgctattcatgatgttagtattcaaaaatcaagaaacacccttcctgggccattggtgtctactaatccattggaagaaaagactggaatccaccacttactagcttcttgggcctcagtcccctcttttctgccatagctaaggaccacctaacctagatggctgttgttattgttcaaagggacatctttagagcctcaagcccaggaatagcccgtggcaggcacctggtaaatgttagttttcattgtcctatcccaacactatgaaacatgcagcactctctgcaactgcccctgtggatttccataggcaggagagtatccagtgttgagtggagctggtattctcagaaacgaagcccctttcctcattttgcgccaatct

SEQ ID NO: 421914 - DNA, 879 bp, Homo sapiens
agtcaaagcaatgcgcacgcgcagtggctttgaaggcggggcaacaaagcctgtggccgatgtggcgctcctcggcccgcgcttcagtggttatgacagtgttcgctctaaggggagaaggaatgtgtgaccatttccaacgagacagagtttcaccatgttgcccagactggtctcaaacacctggattcaagcaatccactcgccttggcctcccaaagtgctgggattacaggtcagtcaccacgaacaggggcactcggcatgctgccccagcactggagaagcagcgctgtgggggcaatctgtcacactctcagagtctgggacttgacttgctaccaacaactgctgtgcaattctgctgagcaggaatatcatgagctgttcaataatgacggacgcattggttgagatgaagtttccagtaaggaagtgacagtgcaatgtggatatttatggctgtaaaataggaagagctttagttcccaggctgaacctgccactgctggagccatttcaacaaggcatcctcacaacaaagaagagatgtgatttggtaccatttcacaccagcaggtgtctggacgaaaacatcaatgtgaataagggccaagtgcagtcctgtcttgattaaattacttaataatattattaaataataataggtctgggcagtattgtttttaacctgactcatccagctgtccttcaaatagctccgtctccctctacccagaactgatttttaaaaagaagtaatttttctccctgggctgggaaaaccctaatgaactgaaacacacttttactttaaaatttttctgtctggcgtttttgtaatcatactattaaatgactctggagtcatgttaatga

SEQ ID NO: 421915 - DNA, 2274 bp, Homo sapiens
ccaataggcggctctccggctgctaagccgagagggcaggggcgccgtcagtagcaccaccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacgccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtcagtcaccacgaacaggggcactcggcatgctgccccagcactggagaagcagcgctgtgggggcaatctgtcacactctcagagtctgggacttgacttgctaccaacaactgctgtgcaattctgctgagcaggaatatcatgagctgttcaataatgacggacgcattggttgagatgaagtttccagtaaggaagtgacagtgcaatgtggatatttatggctgtaaaataggaagagctttagttcccaggctgaacctgccactgctggagccatttcaacaaggcatcctcacaacaaagaagagatgtgatttggtaccatttcacaccagcaggtgtctggacgaaaacatcaatgtgaataagggccaagtgcagtcctgtcttgattaaattacttaataatattattaaataataataggtctgggcagtattgtttttaacctgactcatccagctgtccttcaaatagctccgtctccctctacccagaactgatttttaaaaagaagtaatttttctccctgggctgggaaaaccctaatgaactgaaacacacttttactttaaaatttttctgtctggcgtttttgtaatcatactattaaatgactctggagtcatgttaatga

SEQ ID NO: 421916 - DNA, 746 bp, Homo sapiens
ataaataaaagcaaggagattactaaaaacacactttgcatcctcttgtttctaagctgtatagttctgtgttcttaaaaaggcagttgaaatttctgttaggtggtgatctggcattgatatctttagagaaaaatccttaagtgtgattttaagatggggcagagaaggggttggaggtaggtagtacttttctaggcaaatgttttaaggccacacaagttttttgatagtgtgataacactccctagtttaaaaactttagcaggtgcttgaggaaggggagctcatggcattgtcattttcaatatgaggaagtgttctcaaagttggacttgtcagatttttgtcctttcaccttaaaacaatggtaggtattagggcaacagaagtgatttccccagggtgagaatgaagcataacaatggagtagaagcatttcctttcactttagttgacatgtggaaatccatggattatacaactaggaaagaacagtagagcttcctggagaagaggaggccctcctcaggaaaccctcctattctgtctcagccctagagctggaagtttttcctagattgctctgattgggatatttttgtttccacagccagtgctggtttcgggggtacataggtcacagtttgagttcggaaggcgctttacgcgagatttgggaccagatgtgactggtgtactgcggactgtgtataattcgagtgaagtcagaatctggaggtcgg

SEQ ID NO: 421917 - DNA, 6877 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421918 - DNA, 6661 bp, Homo sapiens
cctcccgggttcaacgcgattctgctgcctcggcctcccgtagttagttcggactgcaggcgttgccaccacgcccatatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421919 - DNA, 7042 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggaactcagaagcaggcgcaaagccgaggcccaaacccgggtcagataaccacattacatggatcccccctcacaaagacaaataaaaaacccaggcaaaaccaattacccggacattttcaggcaccaaccttttaacaaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421920 - DNA, 4651 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421921 - DNA, 6406 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccagggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421922 - DNA, 2025 bp, Homo sapiens
ggccggtcctacgcttataagtgacgggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421923 - DNA, 6467 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatcccacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421924 - DNA, 6653 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattgggacagttcctttttttttttttataagaa

SEQ ID NO: 421925 - DNA, 5600 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcagtaagtagctttcatatctagttcagtgatagcagactggaaaataagccatctatacgcccagctctgcccttgaataataaattatattctggggcataatgggacttgaaaaaataaatgaataaaaaattaaaaacagacagccgggcgtggttgctcgctcctgtaatttcagtctttttggaggctgatgtgtggatcacttggggtcaggagttcaagaccagcctggccaacttagcgaaaccccacctctactaaaaatacaaaaattagctgggtatggtggtgtgtgcctataatcccagctactcaggaggctgaggcaggacagtcacttgaacccaggaggcagaggttgcagtgagccaagatggcaccactgctctccagcctcggtgatggagtgagactgtctcaaaaataaataaataaataaatccaaattatacccacttggtgggggaacattctgccctggtgccaactgtgtagcttacatggcaatcacatgactcccagagcatgcctggacttaatcatgtgattccatgggctatgcagagcactttcactctgaggaatggggatagaatccccgtaagatggaaaaataagacacacactaaagtagcaagtgaggaaaacaaagcccaccttgtccattatgggggtttacaagtctgaaataaaaggttaatctcccagggccaggcacggtggctcacacctgtaatcccgggacccagggcagtacgcgagtcggatcgatagcacaagttgaaagagctagagagcatcatcatttaacggtgcaggaatcctatatctacttggcatacatggcaataccccgtgtatgctggcaaaaaccctattagtgccaggtattgctgctggttgagctaataaccatgtaatgcacggagatgcgggtgatcccgggagccaagatagtgccacatcactcagcccgaacgacaccc

SEQ ID NO: 421926 - DNA, 3481 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagataggtgatgtataagtgttaaactgcgtcaagtgagcacatagtcatgctcatagctgcttcttatatat

SEQ ID NO: 421927 - DNA, 2192 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccacctgcactccagcctgggcaacagagcgagactccatctcaaaaaaaaaaaaaaaaaaaaagattagtctcctaggctgggcgcagtgccttacgcctgtaatcccagctactcagggagaatcgcttgaacccgggaggccaagatcatgccactgcactgcagcccgggtgacagagcaagactctgtctca

SEQ ID NO: 421928 - DNA, 1199 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggtacagtaatggactgcattcctgagcagactcatgagcttgcattatcttgctgtgtgtagatcccttatatatgtgttttccatggatgccttttgagttgttcagctttagccactgtacatttttttgctctctccacagtctgtctaattaaggggggatattctcaagaaagagacctagtttgagcaaacccttttaagcatgactatgttc

SEQ ID NO: 421929 - DNA, 631 bp, Homo sapiens
acccttgagcatgttttcagatgtagtgtcgacgtggattcttccaactattggcccttcaccttgcatattttcctttctcctttagggttgataacagcagaagatagaagagttggtacaacaaatcttcacttagatgtgtctgatgctgttaatgtgatggtgtatgttgggattcccatcggggagggtgctcatgatgaaggtatgctttctagaatccactgctttaggatggtgaggctttgtcttgggaatacagttttgtgttttcatccttagggccagtggcttttccttttttttttctttttcttttttctgtttttttttttggggggcggggaggcagagtctcgctctgtcccccaggctagagtgcagaggtgcgatcttggctcaccgcaacctccgctgcctcccacgttcaagcgattctcctgcctcagcctcccaagtagctgggattacaggtgcctgccaccacgcccggctaatttttgtatttttagtagagacgggtttcgccatgttggccaggctggtctcaaactcctgacctcaggtgatccgtctgcctcagcctcccaaagtgctgggattacaggcgtcagccactgcacccggc

SEQ ID NO: 421930 - DNA, 331 bp, Homo sapiens
gggatagaatccccgtaagatggaaaaataagacacacactaaagtagcaagtgaggaaaacaaagcccaccttgtccattatgggggtttacaagtctgaaataaaaggttaatctcccagggccaggcacggtggctcacacctgtaatcccagcactttgggaggccgaggcgggtggatcacaaggtaaggagatcgagaccatcctggctaacatggtgaaaccctgtctctactaaaaatacaaaaaaattagccgggcatggtggcagacacctatagtcccagctactcggcaggctgagccaggagaatggcatgaacctgg

SEQ ID NO: 421931 - DNA, 427 bp, Homo sapiens
caaggccttctagcactgtgacgaccaattggataacaaccaagggaattgcaggatgaatgacatcctgctatctctggttcaccttgctaaagatgccctcagtgtagtctgtggcagatttcttccccactgctggtgaactccagttacaagagcagatccatggaattgtaaaagagaaaagttgatggacccccaagaaatgttgatctggtgatagtgaggtccaagaaagagatcattagattgtcatgagaagccagcatcactaattcaggctatcttcctttcagaattcaagaaattctattctggcctcttctggatttggagcacctctccctagttcatcgcaacctttgacttttggaagtggaaggagccagtccaatggtgttctagccacagagaacaaacctttggg

SEQ ID NO: 421932 - DNA, 528 bp, Homo sapiens
taaagaatctagacctactaaatgttatgttaacaagctttactattagcagagaatgcatactgttttggtcgactggtgaaaattcttagtctgattcctgttgtctcattttacttctgtttaggtcccaggagtttaggtgtgtgttagtttgcgttgctcctgcgatttaccatgtatttgatcatgtctcaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccgtaagtcaccttctcacttgtcttccaggtgctcctagtgaaaaacttttattttctttcacttaacgggaagattggggacagtggcagatggcattttctgtgaatgaattaa

SEQ ID NO: 421933 - DNA, 323 bp, Homo sapiens
atgctattggttcctgtttacacctcatgacaaacttttcttctctcccccttgccacagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggtacccaaactcctgttttcctcctttgctagttttcattagtgacacataacttccactc

SEQ ID NO: 421934 - DNA, 429 bp, Homo sapiens
aagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcag

SEQ ID NO: 421935 - DNA, 6975 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421936 - DNA, 4416 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttca

SEQ ID NO: 421937 - DNA, 6921 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttagagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421938 - DNA, 1867 bp, Homo sapiens
ctaggtgatgctgttttcatacctgctggagccccacaatagcccagccttgcacgccatactcctcatagagtcgcttacggagggtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421939 - DNA, 6876 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatgtttttttttaaataaaagtcatttaatgtagaatacttttaatttcactttctgtattttaattttgttgaagggctgattgggatttccatgttcttattaaaaatctacattcacaacacaacgagaagaaaaaaatttgcgggcgtttgacacgaaagtataacaatggtaggcggcgccagaagaatgactgcgctaggtccaagactcgggataatggtcgtcaccaaaaccgggaccggttaacccagggtggagcgcaggcacggtaacgccggg

SEQ ID NO: 421940 - DNA, 4184 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatatgctgggattataggcgtgagccaccattcccagccatatacaagacttttaacaagcttctgagatggttctgttatgcagccagggttgagagctagacttagagcagaagttttcactgggcacaagaatcatctggggaatggttaaaaatgcagattcctgtgtcccgcccagaactatgaaatcagaatctctgggggtaaagatctccatttttaacaagcactccaagtgacttcagtacaggtatcctgaagatacacttgaaacactgtcttaggaagtgagggagatgaaagatggatgacaacaaaagggagtttgaaattcagatctggtaaagaagtagtaggagagtttctccttggctgtg

SEQ ID NO: 421941 - DNA, 1558 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421942 - DNA, 1480 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421943 - DNA, 220 bp, Homo sapiens
gcggccgcctactactactactgctcgaattcaagcttctaatgatgtacggggacatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421944 - DNA, 228 bp, Homo sapiens
agacaaagcccacaaaacaccacggggggagagggacatcttcttttatggtcacacacctgtcaggtccccccgtcatggacataggattgggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421945 - DNA, 1468 bp, Homo sapiens
ccaggctggtactgcccgggggttatggatccgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421946 - DNA, 1946 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactgaaaaaaaaaaaaaaaaaaaaaaaaaaaaaaaaaaaaaaaagggggcggcgcccgccccaaaaacaacccccagtcgcccccccggaccacaacgcgcgtcccccgagccaaagcccgccccgggggggcgccaaacccccccccccgcttacgcccctggtggaaacagcgggctcccagaatgtattgcacagccggcccagcagccgtcgaaccctctgtctattaatgtacccacaacacccccgggcgtgttgtgccacacaccgggggcatggaccaacgcgcagcggaattctaggggacatcacccacggccagggatataaggtgcggcccccaggtacaactcggcgcgggaacacgagcaactctttccttgagtggcg

SEQ ID NO: 421947 - DNA, 1826 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactgaaaaacaaacatagatgcaaagaatccaataacaacaaaaaggggggggctcaaaaatacccagagggaccaattagctgacaccgtttgtggaaaggggcctaaagagagcaataaaaaagacacggcgtaaacacgacgaaaatagttgtacggggaaaccttcgtggaacggaccaccaatagccgcaaatattgatggacacttctgttcgttattacgcattaacagtaaacacgcgaatctaggcaaaagctcttcactacca

SEQ ID NO: 421948 - DNA, 1698 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggtgacttgcgccagtcggcctcttttgggcggtcaggttgattcttcccggttctgtagggtcgggctaacttgtatccccatttgtgacatttgatcctgggaagagccgccacgtggggtgacagtgactccagaccagacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421949 - DNA, 1386 bp, Homo sapiens
tgggctggtacggccggaagtacgggacgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421950 - DNA, 1320 bp, Homo sapiens
gtgcacagagaagcggggcgaactgaagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421951 - DNA, 1516 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctattcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421952 - DNA, 1438 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctattcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421953 - DNA, 1882 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggtgacttgcgccagtcggcctcttttgggcggtcaggttgattcttcccggttctgtagggtcgggctaacttgtatccccatttgtgacatttgatcctgggaagagccgccacgtggggtgacagtgactccagaccagtgagcactctggggggcgggccctgccccttaatgggctggtgctggcagtgttggatgatggatttgaggtaaatgttgtcccagtcctgggacaacggcgtggccccgaaggtgcagtacttggagccacaggcagtttgggaatggtccctgggaattcccctaggtggcactgggtgccagctgagacccgggtctctgccctcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctagacatctccatggagatcccccaagaatttcagaagactgtatccaccatgtactacctctggatgtgtgagtagtgagaagccttttggaggaagttacaggcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421954 - DNA, 863 bp, Homo sapiens
cggacgcgtgggtccggacgcgtgggtcgacccacgcggtccgggcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421955 - DNA, 1296 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgttggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421956 - DNA, 632 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaacatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421957 - DNA, 1423 bp, Homo sapiens
cattgtgtgtttgcagctggtgtcttctccaaccctgcggtgcgaaccgcagctgccaatgcggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421958 - DNA, 1506 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421959 - DNA, 1387 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421960 - DNA, 1418 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctagacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421961 - DNA, 1416 bp, Homo sapiens
ccaggctggtactgcccgggggttatggatccgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 421962 - DNA, 894 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgctgtgccacggctgttgcttcggttatttaaataaaaagaaagtggaactggaactga

SEQ ID NO: 421963 - DNA, 1442 bp, Homo sapiens
atcacgtgggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggtgacttgcgccagtcggcctcttttgggcggtcaggttgattcttcccggttctgtagggtcgggctaacttgtatccccatttgtgacatttgatcctgggaagagccgccacgtggggtgacagtgactccagaccagtgagcactctggggggcgggccctgccccttaatgggctggtgctggcagtgttggatgatggatttgaggtaaatgttgtcccagtcctgggacaacggcgtggccccgaaggtgcagtacttggagccacaggcagtttgggaatggtccctgggaattcccctaggtggcactgggtgccagctgagacccgggtctctgccctcaggacccagctgtgatccagcaccgacccagccggcagtatgccacgcttgacgtctacaacccttttgagacccgggaggtgagctactggagagcataggagttcaaggaagggaagggtttgccagtgagacaagttagcttgggtacaggggacttttctgcatgcacaggaaggaagaggcactgtgatcttagttccctgagagaggctagtcagccatgggatgcctcatccttctagggccaccagggccaccaacccaaatggtttgagctctaaaagtcagtcctgggaagatctggaggctggcaaggccttaaccaatgttctgtatgggaaggctttcttgaagaaaataaaggttggggctggttggagtttaggttaggtgtgcagtttgaaagcaaggaatgaggaggactacacctgtttgtcccactggattagaagatggtgagttgtaagaatttaaggggttttcatggtacttaaaacttaaaaaaaaaagccaagcatggtgtgcatgcctgtaatcccacttgggaggctgaggtgggaggattgcttgagcccaggaatttgatggagaccatcctgggcaacagcgagacccccatctcttgaaacgttttaaaaattggctaggtgtagtggcacatgcctgtagtccttgctacttgggaggctgggatggaaagactgcttgggcccaggagtttgaggcttcgatgagtgatgattgcaccactgcactccagcctgggtggcagagagacaaccccacactccatccccagaag

SEQ ID NO: 421964 - DNA, 1562 bp, Homo sapiens
cgcaacggacctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 421965 - DNA, 881 bp, Homo sapiens
cgcaacggacctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcagatggaggttacacaacttgtctgaggccatgagatactaagtggtggagccaagatttgaacccagctagaatgtgcctgtgtactggacatggtctgcatgaaaggcgaggtggctggtgcaggggtgaggggtccatgcaggggccacatccaaaaaggggagagggaagtttccagaaagaagagaggacacatctcccaccattaccagagggtcaaaggagaacaagagac

SEQ ID NO: 421966 - DNA, 1120 bp, Homo sapiens
ggcacgaggccaggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 421967 - DNA, 1421 bp, Homo sapiens
cgcaacggacctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccacttaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 421968 - DNA, 1127 bp, Homo sapiens
agatatgtgagtctgcgtggaagaggggtgcggttgtgtacagggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 421969 - DNA, 1917 bp, Homo sapiens
cgcaacggacctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcatagtctctctctttattggggctcaggggacactctcagggtagctgggggccacgtgaaggggggcgttgcggagcggcacagctggaactccgggatgatgttcaggcttgggggcggggacctccatgcctccagcccccaggtgggagcagaggtaggaaggcacactgcccaggaaaaaaatcaatcctccgcccaaggtacagcagaagcggcctccttggcctaggaggcagacttcctcctgcggggaaatcccttcctggctgggaggagcaggggcccttcctcttggtggcctcggacattcagcaggtgctggcacaggccctggctgggaggtggggcgggcag

SEQ ID NO: 421970 - DNA, 2017 bp, Homo sapiens
catacacacacacacacacacacaaattagccgggcatggtggcacacgcctgtagtcccagcttcttgggaagctgaggcatgagaattgcctgaacctggaaggcggaggctacagtgagctgagattgcgccactgcactccagcctgggtgacagagcgagactctgtttcaggaaaaaaagaacagaaatacctgagactgggtaatttataaataaaagaggtttaagtggctcacagttctgcaggctgtgtaagcatggcaccagtgtctgctcggcttctggggagccctcagggagctttactcatggtgaaaggctaagtgggagcagagatgtcacatggcgaagcaggagcaagagagcagggaggtgccacacaccttcaaacaaccagattttgtgaaaactcactcattactgcaaggacagcaccaagccatgagggatccacccgcaggacccaaacaccttctattagggccaaccttcaacattggggattacatttcaatgtgagattggagggacaagtatcccaactatatcaggcagaatatatgcattgatatatattgaaattataacattctctataatcaagtgactgtaaattatgtcgaatctgaccctggggaatgtgttatctaaagaatttgactaagaatcaggaactctgtgtccatgtcctggatgtatttctgtatgttcctataactctggacaaatcattaaacctctctgggcagcattttcctcatccatgaaatgaatgtgttcaatttgatctcaaagatctttccaaaatattaaatgccattaatcatggaatagaccaaattattatatcacaggaacttgaatccagccagagaaaaattccctggacaattggataaacaaatgtgattgctaccttatggatacaacggacttttacatttctttttagcctttttagtcagttgagggtaactcaagcagagtatgtccaatcattagcttcctttgatatttacattacaggtaaaaacggccaaaaatatattttaaggtctctccccaaatgtttttatttttaaactatcaatgttgtttaaaataatcatgtacttgttgagttcctgaggtttggaacaaattacacataaaatttagaatactttatttctgaaaagcatatacatatatgttatgtttatttttccttgttgattagaaaggtgatggaatatgtgacaatgcaaaatgaattgataatttttctgtattttgagtgaaagttgtctgtaatatgtcaagcaagaatgttataattctacagtaatgtgtgacttcatgacagagctacattctgagaaatttgtcattaggtgatttcatcattgtgtgaacatcatgaagtgtacttacacaaacctaggtggtagagcctactgcacacctgggctagatggcaaagtctgtcgcttctgggctacagacctgtacagcatggtactgtattgaatactgtaggcaactgtaacacaatggtatctgtgtaatctaaacatagaacagataatacattgtgctacaatgtaacaatggctgtggcatcactaggtgataggaatttttcagttccattataatcttataggatctctgtcatatgtggtcaattgttgatcgaaacatgactgtatgtcgtattttcagaaaatggaataggtaatcatcacttgtgtgaattttaatcaaatgacttaggaaagaaactggatgtttcaaaagctgttgcatttattacaaatgtcacaaatacagctcttgccttttgagaatgttggagagatgtctttaaaaaatatgtttgtgtgtaaaaatgtgtctgtatgcaatagctagaaaaatgcctgtgtcttaagtcattactcatgttctaatttttgttctttgtactatttatctgtatgcttgttcttcagtatttcagactcaaaataaatttatttttttatgttaa

SEQ ID NO: 421971 - DNA, 2216 bp, Homo sapiens
gcgacggaaggttgcagaggcagtggggcgccgaccaagtggaagctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccgccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatgtcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttgacta

SEQ ID NO: 421972 - DNA, 697 bp, Homo sapiens
gcgacggaaggttgcagaggcagtggggcgccgaccaagtggaagctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggtacggccaagcgccggcgcggggcagcgctgatccggctcggggcaagggggtgaaaacgcaataccccctttttctcttcctgattatgtacaaattcttttcttctgagattaaaaaactcggaatttttagagcacattttattttacttaagggggcccctagtatcgggatatattggtacgccttg

SEQ ID NO: 421973 - DNA, 1893 bp, Homo sapiens
ataaaatttttaaaaggtggggggctggaactggcagagtataagtggcactgtgtgttgctcagctgaactccatgccctgtgaacaatataagcaacagtcctgctatttccactgacaagagcccgttgcctaccagatgccaggccctgtgcttcctcctgcctttgaggtcttcatgttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccgccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatgtcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttgacta

SEQ ID NO: 421974 - DNA, 1539 bp, Homo sapiens
agattgtgtgtggggtggggtggagcatggaggctatgtctaggaactaggcacacctaaccactgaaaagttggtgtgccatgtgttataacaatgtctatttccttatcagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggtaacactatgcccctttggatctttccttggatttgacttcttttttaaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatgtcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttgacta

SEQ ID NO: 421975 - DNA, 1235 bp, Homo sapiens
gcgacggaaggttgcagaggcagtggggcgccgaccaagtggaagctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccgccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagggaaagtgacgtacacactgatccccatggttgaaggaatggctggagtctgccgttgttgcttccatgacattttgcccctaatggaaagaatatagcacagttactgcatgggtact

SEQ ID NO: 421976 - DNA, 1526 bp, Homo sapiens
gcgacggaaggttgcagaggcagtggggcgccgaccaagtggaagctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccgccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggtaacactatgcccctttggatctttccttggatttgacttcttttttaagatttattcagcacttaataagtgcagacttctgtgtggaggatacaaatgttgatgggtcagagactgtcatcaaggaggcagttcagtatctaaggcttctaaggagaattctgagttgacagggaaaaatggaatcaaagcaattgagttttaaccttttatcctcagaggagccaattatattcttcacttttgctgtacggaggcaaaactatgctgaaagagaaataatctaagaatttgattcccacattcaaaccagaagatgtgacggctcgtttcagcttctgcgctggcttctgcatgactttgagcagccccgctaagtcccatttaccttgcctgaacaatgagatgatcatatttctgcctagggttaccttaagggtctgttgaagggtcagtttggataatgtaatttatgagatgtataaaagcaatatcaatcgatggaggataataaaagtacgcccaaatccaaaaaaaaaaaa

SEQ ID NO: 421977 - DNA, 470 bp, Homo sapiens
gtaaaatagattcttgtcatctgcttggggcatgtttaatgaaagtgatcaggctttctagagattgagatgaaaatataattaacatctttgatttctgtgccatcaaagagctcaaactgttctccagatatatgttggatgcttgagtggttatgaaatcctttgaaattaagtgacagactcagtcctgtgtgctgatgtttaggacagacagacacacacactcaaactcacacacaccaggcttatggggaagaaatcaaagatgacaacagtgtctaattgaagctcctccagggtctggcttcctgccataatggttcacacatatcctgtgttttgaaaacggcaggttttggcttgtgatcaaccaggagggaaacatggttactgctcgccaggaacctcgcctggtcctgatttccctgacctgcgatggtgacaccctgactctcagtgcagcctac

SEQ ID NO: 421978 - DNA, 1161 bp, Homo sapiens
cagagacagaggggccggaagttctcttcacggagccgcgcggctgcgggggcgcaaatagggtcactgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgagtgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccac

SEQ ID NO: 421979 - DNA, 1642 bp, Homo sapiens
cagagacagaggggccggaagttctcttcacggagccgcgcggctgcgggggcgcaaatagggtcactgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgagtgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccacactgtgccttgtgtttggggcttgatagagtgtgaaaggtgtgttgcttgaaaggtgtggccttagacactaggagatgatgggtagaagctccttgagaaacctagcagtggccatagagaagtagactgggtatggggaacctaagtcatagttgtaacctacagctgattggtaagaactatgggccagacatttaatctctccatctatgaaatagtccattctcatttatctagcttaggttatgggctcttcttttagttggatattcacatttatctttcagtgttaactgggtatcagttatgagtctactactgtataatggcatccaaaagaattttaaagtacctcggtttatagggatttacaattcagtagaaacttgttattcatgtgaaacagtgaacataatatctaatgatgtggagcaagtacattaaaaacaggaaggaagagatctgtgattaaactaaag

SEQ ID NO: 421980 - DNA, 1282 bp, Homo sapiens
cagagacagaggggccggaagttctcttcacggagccgcgcggctgcgggggcgcaaatagggtcactgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgagtgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgaagatttattaaaactataagatggctggcaaaaaaaaaaaaggggcgggtaaagttcccagggcagtaggccgttttggaagggccaagggataaaagagggggggtacggggaacgctggttggagacttgggggggcgaagggaaatgttgagttgtgtggtg

SEQ ID NO: 421981 - DNA, 1253 bp, Homo sapiens
ctttcctggaacacaaatacttgggcctttttgtctgcatgctcctgcatgggatgcccatcttcactcattcctgagcctagttcagatatcacctgcctctagatagccatctctgacattccatgccaggcagagttgattcctccttcctgtgatcccatatatctgggaacatatatttaccagaactttttcacttcattttctaattactttttcctcctctgttctttgtgtccggcttctaggctgttttattcaaatttgtatcccagtgtccagtacagttgtctggcatatagttggtggtaagatgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccac

SEQ ID NO: 421982 - DNA, 1248 bp, Homo sapiens
gacagagggggcgggaaaattctcgttcactgtacgcgagggagctgctgcagtaccagagtccggttcatgtgcggcagtattgaggggctagtcatgtgcggctcatcatggatgcgtggctgcaagagttctcgagctgttcgtgagctcgtccatcacgtgcgttgtctcgaaactatagcgcccgctgattcggattcgctagcgcatggtggagccgacgtgttccaggaccaggtgagcgtggctccgacgatgacgattactcaagtatgagatgtgataccatcaagttttgattatcgaagatgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccac

SEQ ID NO: 421983 - DNA, 992 bp, Homo sapiens
  misc_feature (51)..(51): n is a, c, g, or t
gtctggacttctgtaatggttttctcgtacatggttttctcgtacatggtnttctctgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccac

SEQ ID NO: 421984 - DNA, 1277 bp, Homo sapiens
cagagacagaggggccggaagttctcttcacggagccgcgcggctgcgggggcgcaaatagggtcactgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgaggctgttttattcaaatttgtatcccagtgtccagtacagttgtctggcatatagttggtggtaagaaaaatttgaaagatacttctccctctgctctgccccacagtgtgaccctctgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccac

SEQ ID NO: 421985 - DNA, 1303 bp, Homo sapiens
ctttcctggaacacaaatacttgggcctttttgtctgcatgctcctgcatgggatgcccatcttcactcattcctgagcctagttcagatatcacctgcctctagatagccatctctgacattccatgccaggcagagttgattcctccttcctgtgatcccatatatctgggaacatatatttaccagaactttttcacttcattttctaattactttttcctcctctgttctttgtgtccggcttctaggctgttttattcaaatttgtatcccagtgtccagtacagttgtctggcatatagttggtggtaagaaaaatttgaaagatacttctccctctgctctgccccacagtgtgaccctctgtgaccctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccac

SEQ ID NO: 421986 - DNA, 2116 bp, Homo sapiens
  misc_feature (204)..(204): n is a, c, g, or t
cggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgnagcagtcccgagcttcccccaagcggcggcagcaccaccagcggcagccgccggagccgccgccgcagcggggacggggagcccccgggggccccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagaccgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgtgtcttgtatttgttgggcctgggctactgctcaccctggttaggtgagcctctaggaaaacttaaaacaaattttaagccaggtatggtggcacatacctgtggtctcagctattcaggaggccaaggcaggaggatctcttgagcccaggagtttgagaccccatctcaaacaaaaaatacaaaaattagccagccacggggcctgcacttccagctcctttgagagactgaggcaggaagattgcctaagcccaggaggccaagtctgcagtgagctatggtaacaccactgcactccaacctgggcaacagagggagactctgtctctaaaaaaatagaaaaatttgccctgcatggtggctcacgcctgtaatcctagccctttggaaggccaaggcgggcagatcacttgaggtcgggagttcgagaccagcctgaccaacatggagaaaccccatctgtactaaaaatacaaaattagctgggtttggtggcgcatgcttgtaatcccagctactcgggaggctgaggcaggagaatcgcttgaacccaggaggcggaggttgcagtgagctgagatcgcgccattgcactccagcctgggcaacaacagtgaaactccgtctcaaaaa

SEQ ID NO: 421987 - DNA, 1605 bp, Homo sapiens
  misc_feature (204)..(204): n is a, c, g, or t
cggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgnagcagtcccgagcttcccccaagcggcggcagcaccaccagcggcagccgccggagccgccgccgcagcggggacggggagcccccgggggccccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtgagctccggccgccctgccctgccccctctactgtcccggctgctcccgcccgcagccccgacggggctctctgggcgggccgggcgggccagagtgaggggaagagctgggagaaaccgtggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagaccgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgt

SEQ ID NO: 421988 - DNA, 890 bp, Homo sapiens
ttgggaggcggtggacctggagctggaagaacaggaaatgcttattctcttagaggacagtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgtgtcttgtatttgttgggcctgggctactgctcaccctggttaggtgagcctctaggaaaacttaaaacaaattttaagccaggtatggtggcacatacctgtggtctcagctattcaggaggccaaggcaggaggatctcttgagcccaggagtttgagaccccatctcaaacaaaaaatacaaaaattagccagccacggggcctgcacttccagctcctttgagagactgaggcaggaagattgcctaagcccaggaggccaagtctgcagtgagctatggtaacaccactgcactccaacctgggcaacagagggagactctgtctctaaaaaaatagaaaaatttgccctgcatggtggctcacgcctgtaatcctagccctttggaaggccaaggcgggcagatcacttgaggtcgggagttcgagaccagcctgaccaacatggagaaaccccatctgtactaaaaatacaaaattagctgggtttggtggcgcatgcttgtaatcccagctactcgggaggctgaggcaggagaatcgcttgaacccaggaggcggaggttgcagtgagctgagatcgcgccattgcactccagcctgggcaacaacagtgaaactccgtctcaaaaa

SEQ ID NO: 421989 - DNA, 1481 bp, Homo sapiens
  misc_feature (204)..(204): n is a, c, g, or t
cggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgnagcagtcccgagcttcccccaagcggcggcagcaccaccagcggcagccgccggagccgccgccgcagcggggacggggagcccccgggggccccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagaccgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgt

SEQ ID NO: 421990 - DNA, 1509 bp, Homo sapiens
  misc_feature (204)..(204): n is a, c, g, or t
cggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgnagcagtcccgagcttcccccaagcggcggcagcaccaccagcggcagccgccggagccgccgccgcagcggggacggggagcccccgggggccccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagaccgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgtatgcccccccgacattccgcgcggtatg

SEQ ID NO: 421991 - DNA, 698 bp, Homo sapiens
ccgtggtactgagataagcccagggtccggtccgcccctgggaagaggtgctaagaggatatatacattgggggaatttagggaatggtcacagggtgtaataggaggtatctctacaccagagggtgtcccccctcagtcagccatatgcatgaaagagtgccataaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 421992 - DNA, 1697 bp, Homo sapiens
  misc_feature (1154)..(1154): n is a, c, g, or t
  misc_feature (1175)..(1175): n is a, c, g, or t
  misc_feature (1209)..(1209): n is a, c, g, or t
  misc_feature (1225)..(1225): n is a, c, g, or t
  misc_feature (1228)..(1228): n is a, c, g, or t
  misc_feature (1295)..(1295): n is a, c, g, or t
  misc_feature (1311)..(1311): n is a, c, g, or t
  misc_feature (1406)..(1406): n is a, c, g, or t
  misc_feature (1450)..(1450): n is a, c, g, or t
  misc_feature (1453)..(1453): n is a, c, g, or t
  misc_feature (1519)..(1519): n is a, c, g, or t
  misc_feature (1522)..(1522): n is a, c, g, or t
  misc_feature (1564)..(1564): n is a, c, g, or t
attaatcccaatataaggttataatatttttctttacattctttttttagtaagaaaaatgtagttttgaaccatcatataatactagaactaattaggagaaatttaaatcctctttgctttatataagtatagtatatatttatttagcagaataaatgtttatggttgaaaatggctgggattatagttgtgagccattgtgcctggcctattttcagtatttttgtttaaattttgtaaaaaggtaaaataaatgatttttgaaaatagctggagttgttttcatagagtctgtggttataggactatttaactatatattgagtaaaatctatgctatgtcaagttttattcagttgtccctagtagaatatatttctcttttaattctgtatacagtatgagtaactccagtttaaaacactggtattttaatgagtttaaattgtactgttatatattatgatacatatttttcttctggctgtggtttagtttttaaaatttttgatgtccattttaatttttagaaataaaagcttaaaaatatgggtggaagtagatttcagtttgatgattatcttggtgaaagtatagtacctgtgaaatggtggtaataatttgattctttattctattttgattgtagctccttttgtaaggagcatttgtaaaatttagttgctttagagttatacaaatccttttattaccatttattaactgtttgttgttttaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaaggtatgatagtttagtctgaatcactttactgttgaggattggaaactaaaacattactttaaaacaatactataaaaaattaattaatatgtgatttaactcttcaagcaattaaccaaagtaaaatatttttaaaatagtactttacagttatcagttctttttttttttttgagacggagtcttgctccgtcgccaggctggagtgcagtggcacgatcttggctcactgcagcctctgcctcctggattcaagcantcctcctgcctcagcctcccnaatagctaggactacaggcccccacgcccagctnattttttgtatttttngtngagatggggtttcatcatgttggccaggatggtctcgatcttttgaccttgtgatccgcctgcctcngtctctgagagtgctnggattacaggcttgagccaccgtgtccggccagttttccatttttaaggtgttccaaaggccattttgtgttagaaaataatgaagtcaaggccnggtgtggtgtctcatgcctgaaatcccagcactttgggagaccnagntgggtgtatcacttgaggccaggaattggagaccagcatggccaacatggcgataccttgtctctnctnaaaatacaaaaatcagctgggcatggtggtgcatgcctgtantcctagctactcgggaggctgaggcaggagaactgcatgaacccaggaggcagaggttgcagtgaaccgacatcacgccactgcactgcagcctggatgacggagcgaggctctgttcccccctccccccgcc

SEQ ID NO: 421993 - DNA, 361 bp, Homo sapiens
agctcggtacccccaagatctttgagcatcacacatagggcctgattacattccaacagaggaagaaaggagagtcttcgcagaatgcaatgatgaaagcttctggttcagatgtgagttcaattttctaattaatataatttgatcccaaatttgtacctgaaattttgacttgaatttgaacctgaaataataaacccccaacacctaaaattgtgaatacagataatgaaagtgctacagaagcatcatacagtgtaagttaccatatagcgctgagtggagaggctcatactattggagaattgcttatcaaaccttgtgcgaaagatgtggtgatgctcaagatcttaggggatct

SEQ ID NO: 421994 - DNA, 456 bp, Homo sapiens
attaatcccaatataaggttataatatttttctttacattctttttttagtaagaaaaatgtagttttgaaccatcatataatactagaactaattaggagaaatttaaatcctctttgctttatataagtatagtatatatttatttagcagaataaatgtttatggttgaaaatggctgggtgcagtggctcatgcctgtaatcccagcactttgggaggccgaggcgggtggatcacctgaggtcagagttcaagaccagcctgaccaatatggcgaaaccctgtctctactaaaaatgcaaaattagctgggcatagtggcacatgcctataatcccagctacttgggaggctcaggcaggacaatcactggaacctggcagggggaggtttcagtgagtcgagattgtgcccctgtgctccagcctgggtaacagagtgagactctgtctc

SEQ ID NO: 421995 - DNA, 1474 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 421996 - DNA, 1477 bp, Homo sapiens
tgcctccgggtcgcggtcattttgagcccctgtctggatgacttcttgcggctgttctacccctccccctccccgcgtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 421997 - DNA, 1221 bp, Homo sapiens
  misc_feature (50)..(50): n is a, c, g, or t
ctttctaagatcccagttcgacggagactctcctttcttccaagaccaanttccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 421998 - DNA, 1350 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggagacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 421999 - DNA, 1191 bp, Homo sapiens
gctggctctcagacccgcagtgaggtctgacgtcatttcctgccgaaagatgaatgggagggctgattttcgagagccgaatgcagaggttccaagaccaattccccctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422000 - DNA, 1418 bp, Homo sapiens
attaatcccaatataaggttataatatttttctttacattctttttttagtaagaaaaatgtagttttgaaccatcatataatactagaactaattaggagaaatttaaatcctctttgctttatataagtatagtatatatttatttagcagaataaatgtttatggttgaaaatggctgggattatagttgtgagccattgtgcctggcctattttcagtatttttgtttaaattttgtaaaaaggtaaaataaatgatttttgaaaatagctggagttgttttcatagagtctgtggttataggactatttaactatatattgagtaaaatctatgctatgtcaagttttattcagttgtccctagtagaatatatttctcttttaattctgtatacagtatgagtaactccagtttaaaacactggtattttaatgagtttaaattgtactgttatatattatgatacatatttttcttctggctgtggtttagtttttaaaatttttgatgtccattttaatttttagaaataaaagcttaaaaatatgggtggaagtagatttcagtttgatgattatcttggtgaaagtatagtacctgtgaaatggtggtaataatttgattctttattctattttgattgtagctccttttgtaaggagcatttgtaaaatttagttgctttagagttatacaaatccttttattaccatttattaactgtttgttgttttaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422001 - DNA, 1340 bp, Homo sapiens
ctaattttgtgtttttagtagagatgaggtttcttgttggccaggctggtcttgaactcctgacctcaggtgatccgcccgcctcggccttccaaagtgcctgggattatagttgtgagccattgtgcctggcctattttcagtatttttgtttaaattttgtaaaaaggtaaaataaatgatttttgaaaatagctggagttgttttcatagagtctgtggttataggactatttaactatatattgagtaaaatctatgctatgtcaagttttattcagttgtccctagtagaatatatttctcttttaattctgtatacagtatgagtaactccagtttaaaacactggtattttaatgagtttaaattgtactgttatatattatgatacatatttttcttctggctgtggtttagtttttaaaatttttgatgtccattttaatttttagaaataaaagcttaaaaatatgggtggaagtagatttcagtttgatgattatcttggtgaaagtatagtacctgtgaaatggtggtaataatttgattctttattctattttgattgtagctccttttgtaaggagcatttgtaaaatttagttgctttagagttatacaaatccttttattaccatttattaactgtttgttgttttaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422002 - DNA, 3215 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaattctaaaacaataaaaatttggtatacatcacaaaactgatattatgttaaaaagaaaaattggtgtacagtgacccttcgtatctgtgggttccgtatctgcagattcaatcaactgcagattgaaaatatttgagggagagaaatggatggttgtctgtactgaactcttgttattcccaaacaatacattgtaataactatttacatagcatttacattaggcattacaagtaatctataaatgacttaaagtatataggaggatgtgcattggttatatgtaaatactacaccattttatagtggacgttaggaacctggaccaatagacccccacctagtcacattttagaaagaacacatgggatgggagataccgcagccatctttcagtctatcatttggcagctgtaattcacatccctttcctgaggacctctgtttcctatgccattacaaaagctcaaagtctaggagctgatcatctaatcaggataaggtatggatgaggctccttgggtaaagcttcatgaataaaagcgtcatgaataccatttctctgtctgaaggcctgaacttaagaacttatctgctttgttcacctgttaggcataacatcactactctggagattcccattcaaaaagagaaaaggaaaggcttggcttgcaattctgaagtctagccagcctaatgtggctgttctttggggcctaggtatattccctgggggttgttctctggtgcttttgaccctgccctctgatttttccttttctattgaggcacttgtgtttgcagctgagtagttttttttgtttgttttttaaagcctactccctcacagaatttgggggtccaaaggcctatttttactactacccctgtccaagctgacatattttttcatatttttttcctgtgtatttctcatgtatcaatttataatccattctattacacaagagccactcataaagtctattggaaatagtcctttttctatgttgggctccctgtgaggctgatgaacaacatacttcagattctaagccttggacagggtctaaaaggcatgctggtaagacacgtaggcaatttacatgtctgaaatgtcttaagatgcactcatcttcctgaggtcttgagcaaagtatcttttgccccactttggatttggtctttgagagccat

SEQ ID NO: 422003 - DNA, 1753 bp, Homo sapiens
  misc_feature (1480)..(1480): n is a, c, g, or t
  misc_feature (1483)..(1483): n is a, c, g, or t
  misc_feature (1489)..(1489): n is a, c, g, or t
  misc_feature (1491)..(1491): n is a, c, g, or t
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaaggtaancanatcacnangttcagaacttgatgtgggtcccggcacccaacttcgccctatagtgaggcggtttacaattcactgggcgtcggtttacaacatcttgacttgtaagaaccttgttttaacccaagtgaggggctttccttggggggggtttcgacacccgagggatattgaggaggccttacaatccatctcccatttttccccagcctgatggaaaaacccggtccacccccttattcctcgttgaaccccctttttcgacggttgttc

SEQ ID NO: 422004 - DNA, 1528 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaaaaaaaaaaagtcgacgcggccgcgaatttagtagtagtagtagtaggcggccgc

SEQ ID NO: 422005 - DNA, 1534 bp, Homo sapiens
  misc_feature (1496)..(1496): n is a, c, g, or t
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaaaaagatgcggccagaccttccnctctaacatccacctacccctacctgagcgccgcttct

SEQ ID NO: 422006 - DNA, 1321 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422007 - DNA, 619 bp, Homo sapiens
agagaaacataacttttcatcatagcaacaaacttaaaataatgtcttttacttattattgcttggaatcatcaattatttatgcttttttcctagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422008 - DNA, 1312 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaaggtatgatagtttagtctgaatcactttactgttgaggattggaaactaaaacattactttaaaacaatactataaaaaattaattaatatgtgatttaactcttcaagcaattaaccaaagtaaaatatttttaaaatagtactttacagttatcagttctttttttttttttgagacggagtcttgctccgtcgccaggctggagtgcagtggcacgatcttggctcactgcagcctctgcctcgctgaggcaggagaactgcatgaacccaggaggcagaggttgcagtgaaccgacatcacgccactgcactgcagcctggatgacggagcgaggctctgttcccccctccccccgcc

SEQ ID NO: 422009 - DNA, 1269 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagta

SEQ ID NO: 422010 - DNA, 1769 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaacgtatgtataaactttatttgatgaccttttctgctggatatcacctgtgtgttctaccatcaatcatcaacctaaactcagcatgtttgttcatttgtttcttcattcattcaacttttcttgaggaccagtaggtgtcaaggactctgctagacgtggaagaagatgaataacacttggttcttgtccctgaaaaactttcagtctgttagaagatatagaaatacaaggatgaattactagtatgtcccagtaattgaaaatactaaggcaagcttagtggaatagtgaagaagaaatgataaatcgtgtctcaggaagtagagctccaggaaaggtataaaaaggttacatttgataggctgggttttaaaggctttcagcttccctgtctgtaatacaagaaagaactgttgtcaagtgagaaaatccatgtgaaaatgctttgtgaagtttgtaaatactagctttgaagatcacacatgtaagtgcaacaacatcaattttgtattaaggcttggatttgaatcatgattgacatttgctagctatgtgaccttgtaatactactactacattataataatgtagtaatattattataactactttatgatcctttcagtttcttgatcagttgaatggagatgatactacctctcttaatgaactgttggaattagaggaaataatcagaggcaatgtctggcaaataatagactcaaaaaacattagtttctttccttcagtctagtcggcagtaaaagatgaggaattagaaacgggaaatacaggtctgtaattctttatctaaaatcctgaaattcaaaaaggtttaagccaagtttttttttgttttttgtttttttttttttttttgagatggagtcttgctctgtcgcccagtctggactgtagtggtgcga

SEQ ID NO: 422011 - DNA, 1289 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggtgggagacggacactgggtggaggatggagtgcggtaatcagcggttgtaggccgcttaggctttaatccagcgttgttttgtgtaaagaacttaaaatggtattgtcttaagcgccgtgtcagccctgacagtcttcctggtgtttctaggaaggatgccgttatgggaaataagagggtttcattttttctcatacggttgtagggtaaaggtagtttattcagcaggctccatccatccatgaattcagctgaccttttttatttcttttctctaattaaggggttggcatgtagtaggccttcatggcttattgactgaatgaattatggaagggctcagttgctgtcctcattgtgtatgccatttcctgtttccatgcaaattgtttttaaaatgagaataatcatgatcccacgtaaacgttctgtaaaatacggttacttgatctgttggtctgagtcccaatatatgagtttttaaaaaaagaaccaaataaaaaatgtatattcttggaattttatgcatttttttcttatattcttggggtggaaggaaatttggagatacagaatttgctgttagttttacctcacagggagaaggatatgtcgtctttgttattccataattttggagtgctcctttgtgggagaggttgaatgtttctgatgattatttcattttttaatatggaagctcagaaatgacttgaaattttttttctcttctattttggggaattatcctaatcattgggcatagattcgagaaacgaccaaaacataggatgtgaaagaacccacttccaggaggaaaaaatatgtctgttattttattgatatcttgatagt

SEQ ID NO: 422012 - DNA, 555 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacgtaagtatgaacaacattgtagttttcatagctttttaaaacttaaataaaattatttttatc

SEQ ID NO: 422013 - DNA, 1413 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422014 - DNA, 1660 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422015 - DNA, 1660 bp, Homo sapiens; identical to SEQ ID NO: 422014

SEQ ID NO: 422016 - DNA, 2014 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaaaaaaaaaaaaaaaaaaaaaaaaaaaaaaaaaaaaaaaaaggggggggccccctaaaaaaatatctccccgcggggggcccaaatttaccgggaaccccttttcctgggtacacacagggagcgccccacaagaagagagcgcgctataatacagcacaggaccgggccaggacgttcacacaagcgcgtgcgaagactgggaaacactggcacacggagacacccccgggcacgaggacacccaccacacagcgagggggggggcgcgacaacaacttagggggggggcaccaacacccctccccgacacacgaggagaaattatctaaaaacacgccccctaagggaagcaaaccacataaccacaaacactcataacacagcgcgaataaataaaaggggggcgtcacaaacaacacactagccgccgcgataatacaccgcgaccgccgcggctcgcagaaaaacacaaaatggccggcacaacaacgaagcaaaaccaaagatcaagcgagcaccaacacttttttaccagccccg

SEQ ID NO: 422017 - DNA, 1422 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagta

SEQ ID NO: 422018 - DNA, 1525 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaatgcgatgcgcccaagcccctctttcccctcacccacaatcctcgaccctaa

SEQ ID NO: 422019 - DNA, 1366 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaactcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422020 - DNA, 1267 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaagtcaaagtaaacaagtatggagatacttgggatgagtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgaa

SEQ ID NO: 422021 - DNA, 1231 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagcaagccaggtggaaagaggcccaaaaagcaggcaacgtggggaaacgggggacggaaacacacgggcgaaagagtaaacgacgccagaggcgaaaagaagtccacgacgccttatcgcgtgggggacccg

SEQ ID NO: 422022 - DNA, 1158 bp, Homo sapiens
gatcatgaggacactcaaccagcactaaggagatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaacgtatgtataaactttatttgatgaccttttctgctggatatcacctgtgtgttctaccatcaatcatcaacctaaactcagcatgtttgttcatttgtttcttcattcattcaacttttcttgaggaccagtaggtgtcaaggactctgctagacgtggaagaagatgaataacacttggttcttgtccctgaaaaactttcagtctgtaaaatgtagtagtattttcttcttatagtagtatttacagcccatagggggtggtcggacccagctcactggccgcgtctgccatgtactgagccagcagctcccc

SEQ ID NO: 422023 - DNA, 895 bp, Homo sapiens
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaa

SEQ ID NO: 422024 - DNA, 417 bp, Homo sapiens
acgatataaactcagcgcgacccgacacacgccacgcggctgtaaagaaaaccaactttaccgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatatacccca

SEQ ID NO: 422025 - DNA, 3160 bp, Homo sapiens
  misc_feature (1432)..(1432): n is a, c, g, or t
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422026 - DNA, 3040 bp, Homo sapiens
  misc_feature (1312)..(1312): n is a, c, g, or t
cggtacccacgttgacacttcaggggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422027 - DNA, 2847 bp, Homo sapiens
  misc_feature (1432)..(1432): n is a, c, g, or t
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgtaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422028 - DNA, 3003 bp, Homo sapiens
  misc_feature (1275)..(1275): n is a, c, g, or t
cggtacccacgttgacacttcaggggcactaggaacagccccgagcggcgagacggtccccgccatgtctgcggccatgagggagaggttcgaccggttcctgcacgagaagaactgcatgactgaccttctggccaagctcgaggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422029 - DNA, 3136 bp, Homo sapiens
  misc_feature (1408)..(1408): n is a, c, g, or t
gggagaggactcgggaaaggtggagtcggagacagacgggacaagcagcatattcagggatcaggctggcctcccggaaagcgtgggcatcggaggaccccgcgggggctgcccaggctgagggtcgcggggctggagggcagctgcggcgccgggcgctggcagctggaagggccagcgctgacgtatgtctgccccgcggcccggcgccctattcctgctgtcctgcgcggtgggcgcggacggcggggcccctgcgggcgggcgcgttgacggaggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422030 - DNA, 2909 bp, Homo sapiens
  misc_feature (1181)..(1181): n is a, c, g, or t
gtttttaatcttttaatcacaacgatcttccgcgcagcgccaacctcttcggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422031 - DNA, 3102 bp, Homo sapiens
  misc_feature (1432)..(1432): n is a, c, g, or t
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcattcggttcttcaccggggaatcccccctagggttcaaaccccaatcccccattttcttcgctatccctcaacccggacatcattacggggttttcttttta

SEQ ID NO: 422032 - DNA, 2585 bp, Homo sapiens
  misc_feature (857)..(857): n is a, c, g, or t
accttgtggctgactcctggggtcctttcccccggtacctattgtagataactctatggttggggcactcctttcttgccctattccacagggacacctgaattctcttgtttcctccttacctgttccaaattccatttacttgatcattctcagtatccactgtctaaacgccatctgcttgcatttagaccagcttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422033 - DNA, 3107 bp, Homo sapiens
  misc_feature (1432)..(1432): n is a, c, g, or t
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422034 - DNA, 2950 bp, Homo sapiens
  misc_feature (1432)..(1432): n is a, c, g, or t
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtataaaagttactattgctcataatgacttacaggctaaaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttattacctatcctgaagatgtgatacactgaatggaaataaatagatgtaaataaaattgagttctcatttaaaaaaaaaat

SEQ ID NO: 422035 - DNA, 1060 bp, Homo sapiens
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatatacccca

SEQ ID NO: 422036 - DNA, 2102 bp, Homo sapiens
  misc_feature (1432)..(1432): n is a, c, g, or t
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccntagtatatggcatatgaataccaggatagctttataaagcagttagttagttagttactcactctagtgataaatcgggaaatttacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgagacaatgcaggtacacagtggagagtttccagaggtaaggaaggttgctaggggtacaggaaggttgctagggtacaggaaggttgctaggg

SEQ ID NO: 422037 - DNA, 622 bp, Homo sapiens
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagcagatttatttagaacctccatgtgccagattctgttctacatctgggagatactttggcgaataaaacaaagtccttgttgtccta

SEQ ID NO: 422038 - DNA, 613 bp, Homo sapiens
tgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaaggtgtggtctggactagggtttctccttccccgctgcctgctgtagtagtggtcgtggtggcccatcttctccctcctc

SEQ ID NO: 422039 - DNA, 3146 bp, Homo sapiens
ggccgtgtccgagcgctggcggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccggacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggccatgcggggcacgagtgtgggctggctcaaactgagaagtgccaatccccaagaccaccctgtgatccagcccatacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctgggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggttgacagggtgagaccctgtctcaaaaaaaa

SEQ ID NO: 422040 - DNA, 2879 bp, Homo sapiens
ggtgttgttcggcacacaggctttgagacaaccagggtgcggagacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggccatgcggggcacgagtgtgggctggctcaaactgagaagtgccaatccccaagaccaccctgtgatccagcccatacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctgggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggttgacagggtgagaccctgtctcaaaaaaaa

SEQ ID NO: 422041 - DNA, 3407 bp, Homo sapiens
ggccgtgtccgagcgctggcggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccgggtgagtagccgcggaggcgccccgaccaccccgcagcagcgccgcccggccgctagcccggagaggcctgggggccggaggtttggggccgggctggacgccgagacccgggcccgctttacacaatcgccccgccgcgcgaagcgaaacgggtggaacgcagactgccgaagctcactgactcctttgagggagcgaattctttcagctacgcggggttagagcggtaggagtgcccgctgcccgaccccaggctttctgacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggccatgcggggcacgagtgtgggctggctcaaactgagaagtgccaatccccaagaccaccctgtgatccagcccatacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctgggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggttgacagggtgagaccctgtctcaaaaaaaa

SEQ ID NO: 422042 - DNA, 3354 bp, Homo sapiens
ggccgtgtccgagcgctggcggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccggacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggccatgcggggcacgagtgtgggctggctcaaactgagaagtgccaatccccaagaccaccctgtgatccagcccatacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctgggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctccttactctgttttggcagtatgggcagcagacagtgagactctgtttctacaaaatattaaaaaaattaattgggtatggtggcatgtgcctgtagttcccagctaccgaagaggctaaagcgggagggagttgaaattaggaatgggctcatgcagaaatatttgtaataatatttaaacgaaatcctttgggtaaaaaaagcataatataaaaaggacacctctcttcccatgtcattccatagttgctcacatgaagagagtctccgtcgaact

SEQ ID NO: 422043 - DNA, 2897 bp, Homo sapiens
tagagggctagtccctctgagacgagcgagcaggcagccattcactaacatgcgttcattccacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggccatgcggggcacgagtgtgggctggctcaaactgagaagtgccaatccccaagaccaccctgtgatccagcccatacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctgggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggttgacagggtgagaccctgtctcaaaaaaaa

SEQ ID NO: 422044 - DNA, 2988 bp, Homo sapiens
ggccgtgtccgagcgctggcggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccggacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggccatgcggggcacgagtgtgggctggctcaaactgagaagtgccaatccccaagaccaccctgtgatccagcccatacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctgggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtgaaccctgatggcaccactgcactccagcctgggttgacagggtgagaccctgtctcaaaaaaaa

SEQ ID NO: 422045 - DNA, 3092 bp, Homo sapiens
ggccgtgtccgagcgctggcggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccggacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacaggctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggccatgcggggcacgagtgtgggctggctcaaactgagaagtgccaatccccaagaccaccctgtgatccagcccatacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctgggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggttgacagggtgagaccctgtctcaaaaaaaa

SEQ ID NO: 422046 - DNA, 7444 bp, Homo sapiens
  misc_feature (6453)..(6453): n is a, c, g, or t
  misc_feature (6843)..(6843): n is a, c, g, or t
  misc_feature (6888)..(6888): n is a, c, g, or t
  misc_feature (6892)..(6892): n is a, c, g, or t
  misc_feature (6991)..(6991): n is a, c, g, or t
  misc_feature (7443)..(7443): n is a, c, g, or t
ccgcattcaagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctngaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcagnaccaacttcagttattcagaaattttttcttaaatagcatttatnagtncagagatgaagcaaacaacagtggagtcataaatgaaagctttgaaggtgaagatggcgatgtgatttgtttgaattcagatgacattatgccagttgntttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcctgatttctaatcttggttctgagagccatttggtttcagttgtagcaatccccataccagctgcctgnc

SEQ ID NO: 422047 - DNA, 809 bp, Homo sapiens
gaattttatgtattgatacttttacttctcgttttattagaaaaaactttcgtgtacacccacccagcagtgcattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggctgtttgcaaccgcctcttttccgcgaaattctttccgattcccgtttaatgcaccattgtcatatttgcgctagctccatacctttcttcaccgtttccattgcaaatagagggaagccctgttcccacatcgttggatggttttataactctattgaattctttgtaactatttgccttcctctcgggcgtttcggctcggcatctcgaaatttgtactgttggatttcgcttatctggtcttgtcgtccgttccttctctccctgtcccatggtaaataactttatttacg

SEQ ID NO: 422048 - DNA, 5971 bp, Homo sapiens
ccgcattcaagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagggactgaaaacacaccgtcgatgaaaaccagccactgatgaacagcctcagacctggccagtacggggagcacgtgaaccataactggcttagaaggactgatttcatgccaacttgaggggagaattccaaattccaaagacactcctctcacaggactatgaaaccatcttttaagaagttccaaggacaaaagtcacttccataattatagtcctggcaacttgatctttagatctatttttgcttcatctggctctggcattcccataaccttaaaaaatgttcctgttcatactagagaattcccttggcccttatttctaattgaaacctccttgaagtttctgttgctgcttttcatgcagagtgaaatacattctaacctgcagaactgtc

SEQ ID NO: 422049 - DNA, 1919 bp, Homo sapiens
ggcctggagacagccgagagccgccttcaaggagggctgggggcggggctagaggaggggctgggggcgggtttcccgatgaaggggcggccatggcagctgcgcagaggcaacgcaggctgctacggagcgcgcgcccggctttgaatgagcggggctgggagtgagcgggcggagcgcgagctcgaggaagagacaggcagcgcgcgtgagcgcgccttgtgtgcgcgcgcggcccgcggcagctcggagcctccgccgggcgggcggggagggggaggggcaggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataata

SEQ ID NO: 422050 - DNA, 1734 bp, Homo sapiens
catggcacagaatgttcgattttactaccagctctcacactccgcttctgtttccccttctcttacgggccgctgctcaaacctttatttatcaaatttaagttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataata

SEQ ID NO: 422051 - DNA, 1504 bp, Homo sapiens
  misc_feature (234)..(234): n is a, c, g, or t
tgcaaaaatcaatggttctctcttcttaataccaattttctgagttttcttaatagtggtgtcgatgtcgttaaaatagtcaggttccagttgttccaaagaattatgttgtgttgcgacattcgcattccctccttcgatctttacactggtgggtgcatcttcatcccaggaagtccactcttcaacatctgtctgcttaggaactgatgaataatcaactgtagttggcanagttatttggtctccacttaatttccgtcctctgccagatctgcatattaatctctttaggaatgagaatactgttgctaggcaggtacaaaatttaaataaccgaaactgggtgatggcaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataata

SEQ ID NO: 422052 - DNA, 1347 bp, Homo sapiens
gcctttatgcctcattttacttatttgtaaaatagagataatatttcttctatttcacaagtcacgttctaaggactaagagaaatcctgtttttgaaaatatttggaattttcaaattagtgagaaaattttaagactttcaacattttatttggtgataataaaaaggcactgctatttctttctagaatttatttgccattttacctgtttggtattttctaaaagtaaaagtatgtttcttttcagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataata

SEQ ID NO: 422053 - DNA, 919 bp, Homo sapiens
ggcctggagacagccgagagccgccttcaaggagggctgggggcggggctagaggaggggctgggggcgggtttcccgatgaaggggcggccatggcagctgcgcagaggcaacgcaggctgctacggagcgcgcgcccggctttgaatgagcggggctgggagtgagcgggcggagcgcgagctcgaggaagagacaggcagcgcgcgtgagcgcgccttgtgtgcgcgcgcggcccgcggcagctcggagcctccgccgggcgggcggggagggggaggggcaggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtctacaagtcattgggttggggctacaatcatctgaaggcttgattgtggtcgaaggattcatttcaaagacagctcacttctacacctgacaaattaatgctgtttgtttgcacaaagcctcagttccttgctgtgcacctctccaaggagctgcttgaatttctttatgatgtaactcctgattttccca

SEQ ID NO: 422054 - DNA, 394 bp, Homo sapiens
gtaaataagttttatgttcaaactaacctgtttatctcctcgctggttttggataccttcaaaacttcaaatttcgtggacaggacaggttatatttaagctgaatatcttgattgcagtatttattcattaattcctagtcatttttaaatactttttctctacttcagatctagaaaatagaggttcagttgttttgttcattcaaattcttacactttccactaaaataacatgcttaatactatttaggaatagacagaccaactttcattattataatcatcacagaactttgatgtattcgtttcattatgggaatgttttaaagtggttaggtgaaattcggaataggtatttctgtctatactacaatagtgttgtttttatattt

SEQ ID NO: 422055 - DNA, 312 bp, Homo sapiens
gttttatccttacaaccattgaaaactcgaaaacctggtttttgacttgttaatatgatttaaattataattttaaaatttactgtgttatagtttctagagaaaggtaaaaaatatcttagatttttcttagtgcataataggtcttttcaggacaggagtatgacttttgaaatcaatttaatgcattttttgttttgtgcctcttccacaggttttgattcccaccatggccatcacccagtttcggttatttaaattttgtacctgcctagcaacagtattctcattcctaaagagattaatatgcag

SEQ ID NO: 422056 - DNA, 2021 bp, Homo sapiens
tccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatcccagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataata

SEQ ID NO: 422057 - DNA, 2195 bp, Homo sapiens
gtactcctaggtattggcatttctttaatagattcccagatttgtgaaccactggactaaatgagctccatggtaactttcaatttactagctatgtgactttggtcaagttatttgacctctcttaattcaatttcctcatctataaaatggatataaggaaatatattcatctgcaagttaaaaatatttaaagtattttaaatagtattatgttcatgtggttcaaactttaaaaggtacacagagatttaatatattctattttatacttttttattttttgaattgtagatttttgtattaatagatttaggtaaaattattttcaaaaactcagaatgaagggttttatccttacaaccattgaaaactcgaaaacctggtttttgacttgttaatatgatttaaattataattttaaaatttactgtgttatagtttctagagaaaggtaaaaaatatcttagatttttcttagtgcataataggtcttttcaggacaggagtatgacttttgaaatcaatttaatgcattttttgttttgtgcctcttccacaggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataata

SEQ ID NO: 422058 - DNA, 358 bp, Homo sapiens
aaaaaaatacagttttaaaaagtaacgtgtttttttcccttgcctttctgatgatagatgtatcagttaggatgctcttggttgtgagtcacagacaacttgatataaatctagttaaatcataagaaagactccagaagtagggcaggctccaaggtgagtataacccagccccagggctgacacggggacctcgatttgctctgtctccaactccatcctcagcagcctggacgcaccctgaggcccaagcctgctgaggtcaccagatggccagtgtcacatgcatcctcatgtcagccagcaggaaggagcagtcctaggagagatgggatgccttcaactggaagcagatatt

SEQ ID NO: 422059 - DNA, 892 bp, Homo sapiens
gcggccgcggcggtggcggagactgtggctttaagagcgtgccgggagcccgagccccagccgggccgcgcttcgccgctgcgcaccccagcggagccaagccccacgctggccggacagggccgcctgtcgccggtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccactctgggctggaaatacgaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctctttgctttgtatctgtttgtgagttgatcctggcttctctctctgttctagttttggctgaaaacaaaacaacaaaaggaacagatccttgaccgcatggcggcagcccaccttggtaagggccccagggcccatgcgagagctgcctgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaaggacaaagagaaa

SEQ ID NO: 422060 - DNA, 488 bp, Homo sapiens
cggtgactatccagtgagccttcagtgggtgcaaggcgccatacttgctgtgagagagctgagtagagtgttggtttttccataactacagggggaaaaaaagtcattaggctttccctttgtgtcagtgaaaccaaaagtgcttcttacaacgttcgctctgttcatgggttgtctatctaacattgagcagcattggagaggccacagctgagctatggagatgctaaattaactcatggcctcagtcagttcattctttaatttcctcaccaaattattgacttagagcataaccaaagacctcattcattcaccccaggtgggttggggtaattggagtttgttggtgaagtttgggggcggggtgttgggagtagagacagggtaaggggtggaagggtggaggtaggaacaaaattgcgccgctcctggagacctgataacttaggcttcaaataattgacttgtctaaaaggacaaagaga

SEQ ID NO: 422061 - DNA, 2326 bp, Homo sapiens
gcggccgcggcggtggcggagactgtggctttaagagcgtgccgggagcccgagccccagccgggccgcgcttcgccgctgcgcaccccagcggagccaagccccacgctggccggacagggccgcctgtcgccgggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccactctgggctggaaatacgaacatgcttttgaaagcagccagaaatataaagaaggcaaatacatcattgaactagcacacatgatcaaggacaatggctgggactgattggacagcatctacccaacccagtgtccacgtgaacgccattcaaccaaacacagccaaactcgatacccacaagctgtcagctgaacctgactgagtgttcttcctgagttcacgaggataggctagagtgcatttttactggtggatcagtgtgtgcgaaagagatgaccctttataaagagattttcaagtggatatatataaaagaaacagttgcttgtaaaatatacttttgtaaataatatttaattttttaaataatatatttggtgctgttttctcagatcccctgagagcactttttattttccttttaaattctatggtttcctttgcatttcttgaagtatattttaagggaaacagtgatcaccaatacatgttttcagttttttttttttttaaggtctctatcactttaatctggatcaaggctttgaagcaatgcctctctgcattttttccccagtggaacagactctgcagtacattaatcaggttgagaattgaaatattttcttgcatcagtattggctagaaaagaaaataaataaaaccaagttaatttagtagtaacaacttacagtgattcttcctgttggaagaatttccaacaaatcagaatcacgtttttagttgtgcgtgtgcgcgcacacgtgtgtaaaaagcactttcgattgtgcctcctgttttctcgagtggggacactttaactacagtttacacctcgggcgcataaagtttttcttctctttctctctggttgtttctgtttctgagtggaccaacagcagaacccacgaggatttgttttgagtatggagctgttgcgggtttgctcctttttcttgctttgcgtgctcagtttttacagactgtaaaggagatgtgttgtttgtgaagatggagcagagtcaaatctgtgcttctaactgagatgagagtgtattaatcacgtatcgcagggctccagctgttttagaagccacatcatgttaaacattaactggtttggattaaaagaacattaatattataatacacatatcttagtggtaaacagctttttttttttaaggtcagattgcctcaggtttagaaagaggctgagaaatcaaatcttgaacacaatcaacttacatattttaaaggaatctgcctcaaatgagaaaatatgctagttatctagatagaggaaagagatatttacttttttaaaaattaaaatagttatgaaatctggcagaaaaggtaaagcctagaagaaactatgaaagctattctcatgttaccaaattctatctgcgcatatgtttttgtataacatttcggtgacagtgggagtcggttccctttcccaacctgcagagactatcttccaatacagaatctgtctatttatgcttgtgtttacaaactgtatttgttgggtttgggtttttgttttctttggtggcatttttcaggtcactttgcttctataacaaaggtaattgttttcaaataatttgtcttcaccttttcctgtatttgtacatagtgattcagtattagagaaaagtgcattgtttctgtcatatttccaatctgtgttggtgctcatttgagaaaataaaagttttcaaatattaa

SEQ ID NO: 422062 - DNA, 2463 bp, Homo sapiens
gcggccgcggcggtggcggagactgtggctttaagagcgtgccgggagcccgagccccagccgggccgcgcttcgccgctgcgcaccccagcggagccaagccccacgctggccggacagggccgcctgtcgccgggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtctatctaacattgagcagcattggagaggccacagctgagctatggagatgctaaattaactcatggcctcagtcagttcattctttaatttcctcaccaaattattgacttagagcataaccaaagacctcattcattcaccccaggtgggttggggtaattggagtttgttggtgaagtttgggggcggggtgttgggagtagagacagggtaaggggacgtgagaaaggaaaaggcatgaagttctatacctcagccagcagctgccttcgtttggaactgaagtccagccagcagactctctagctccatctcccctgtgccaccctaggtcatatgaccttggccaccttggagtagacccagacccctcgggacccgggacattagtctcaggctgctgatggattgatttgacatgaaccaaacacagccaaactcgatacccacaagctgtcagctgaacctgactgagtgttcttcctgagttcacgaggataggctagagtgcatttttactggtggatcagtgtgtgcgaaagagatgaccctttataaagagattttcaagtggatatatataaaagaaacagttgcttgtaaaatatacttttgtaaataatatttaattttttaaataatatatttggtgctgttttctcagatcccctgagagcactttttattttccttttaaattctatggtttcctttgcatttcttgaagtatattttaagggaaacagtgatcaccaatacatgttttcagttttttttttttttaaggtctctatcactttaatctggatcaaggctttgaagcaatgcctctctgcattttttccccagtggaacagactctgcagtacattaatcaggttgagaattgaaatattttcttgcatcagtattggctagaaaagaaaataaataaaaccaagttaatttagtagtaacaacttacagtgattcttcctgttggaagaatttccaacaaatcagaatcacgtttttagttgtgcgtgtgcgcgcacacgtgtgtaaaaagcactttcgattgtgcctcctgttttctcgagtggggacactttaactacagtttacacctcgggcgcataaagtttttcttctctttctctctggttgtttctgtttctgagtggaccaacagcagaacccacgaggatttgttttgagtatggagctgttgcgggtttgctcctttttcttgctttgcgtgctcagtttttacagactgtaaaggagatgtgttgtttgtgaagatggagcagagtcaaatctgtgcttctaactgagatgagagtgtattaatcacgtatcgcagggctccagctgttttagaagccacatcatgttaaacattaactggtttggattaaaagaacattaatattataatacacatatcttagtggtaaacagctttttttttttaaggtcagattgcctcaggtttagaaagaggctgagaaatcaaatcttgaacacaatcaacttacatattttaaaggaatctgcctcaaatgagaaaatatgctagttatctagatagaggaaagagatatttacttttttaaaaattaaaatagttatgaaatctggcagaaaaggtaaagcctagaagaaactatgaaagctattctcatgttaccaaattctatctgcgcatatgtttttgtataacatttcggtgacagtgggagtcggttccctttcccaacctgcagagactatcttccaatacagaatctgtctatttatgcttgtgtttacaaactgtatttgttgggtttgggtttttgttttctttggtggcatttttcaggtcactttgcttctataacaaaggtaattgttttcaaataatttgtcttcaccttttcctgtatttgtacatagtgattcagtattagagaaaagtgcattgtttctgtcatatttccaatctgtgttggtgctcatttgagaaaataaaagttttcaaatattaa

SEQ ID NO: 422063 - DNA, 1204 bp, Homo sapiens
gcggccgcggcggtggcggagactgtggctttaagagcgtgccgggagcccgagccccagccgggccgcgcttcgccgctgcgcaccccagcggagccaagccccacgctggccggacagggccgcctgtcgccgggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccactctgggctggaaatacgaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctctttgctttgtatctgtttgtgagttgatcctggcttctctctctgttctagttttggctgaaaacaaaacaacaaaaggaacagatccttgaccgcatggcggcagcccaccttggtaagggccccagggcccatgcgagagctgcctgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaaggacaaagagaaa

SEQ ID NO: 422064 - DNA, 530 bp, Homo sapiens
agacgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcacca

SEQ ID NO: 422065 - DNA, 642 bp, Homo sapiens
agacgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccaaaaaaacaaaaacaaaaaccccggaggacctctagtggcgggctgcggacacaacgggcgcccggacacgggcccagggccactcagcggtttccctgacccagtttcctgc

SEQ ID NO: 422066 - DNA, 767 bp, Homo sapiens
gtatcaacgcagagtggccattatgggggggcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccaaaaaaaaaaaaaaacaaaaaaaaaactcggggcacaagttgaacggtatggccaaatatgtcggcgctaatatatatatctgccagggggccgagcgtgatggctcaccacctgtatattccgcacttggggacgtcaaggaagcaaaatacgaacccaaagttagaaatcttgccagggaaatctgtttacaaaatacgggcgatacattcgatacccctctggaaggtggcaca

SEQ ID NO: 422067 - DNA, 508 bp, Homo sapiens
aaagacggctaggtagcgagcgggtgggggtcgcacgtctatcagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcacca

SEQ ID NO: 422068 - DNA, 560 bp, Homo sapiens
  misc_feature (34)..(34): n is a, c, g, or t
ggggatgagacgggatggcgtgggctgttgaatnggtgcgcgagggtatggcggagggatatggatggcgctcgccacgcgttctcattcgaacggtctgtaggtaactggccgtccgtgtcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcacca

SEQ ID NO: 422069 - DNA, 1740 bp, Homo sapiens
  misc_feature (697)..(697): n is a, c, g, or t
  misc_feature (768)..(768): n is a, c, g, or t
  misc_feature (845)..(845): n is a, c, g, or t
  misc_feature (1214)..(1214): n is a, c, g, or t
  misc_feature (1724)..(1724): n is a, c, g, or t
gagacggagttttgctcttattgcccaggctggagtgcaatggcacaatctcagctcactgcaatctccatctcccgggttcaagcgattctcctgcctcagcctcccaagtagctgggattacaggcatgtgccaccacgcctgactaattttttgtatctttagtagaaacggggtttcaccatgttggccagtctggtctcgaactcctgacctcataatccgcctgcctcggcctcccaaagtgctgggattacaggtgtgagccaccacgcctggcccctgattttaagcaatacccagcttacttggattttggggtgaagtcagtgctgagtctcccaactctgttggcactccaggggtgggacagacactgtccctgggtgcagaggccctggaggcagcactgccctttcccccaaaggccaggctctgaccttgagagtggtgggagtgggtgatccttctgggaggttggactcccaggaccgctggctgttggggagcattgattgtgaagaccagtcaggtggggtaaggggtgtatgtgcggacactcagtaggccagccacagacttctcacttcttttttttttttgagacagagtttcgctcttgttgcccaggctagagtacaatggcgcgatcacggctcactataacctctgcctcctgggttcaagtgattctcntgcctcagcctcccgagtagctgggattacaggcgcctgccacaagcccagctaatttttgtatttttagnagagacggggtttcgccatgttggccaggctggtctcaaactcctgacctcaagtgatccgcccacctctgcctccngaagtgttgggattacaggcgtgagccaccgcgcctggcctaacttccatctcttgagggctcccacagccacttctcacatgaaccttcctcagcaccttcccactgaggctcctgcttgaccatggtcaccctgcagctcaacggggaaggcagaggacagtaagggctgctcacagggaaggcaaacctagggcagatcaggaaaggcctccctgagccagatcccattatgctggggctgtgggataagaatgaattcgccccagaaggaaggcagctggttcctggggaggagacagaaatctgcaaagggagggtgtccaagtctggctgcaggagccacccagtgaccctacgcaggggagngtcatggcttccccagggcacagccccagacccttcagcagctaaaaaagatcagctgtggaccaagagggtgctgagaccgccctgccctctggaaggggaaaggccacggctacaggcagcaggtaccagtgtcccagagtgggtcctacaaaggctaacaccttcctggagaaggtgggattctgcttggggcaaaaggatgaatcagattcagaaaggtcaggagggaaggaaagactaggcagggtgtgcagaggccacaaggagggcaagaccctaggcaaggcatgccgctgacggcatctgaaccaagttttatgaccacaacttttttttttttttgagacagagtctcactctgtcacccaggctggagttcaatgatgtggtctcggcgcactgcaacctccgcctcccgggttcaagcgattctcccatctcagcctccctagtagctgggactacaggagcatgttaccacacccggctaatttttgtatttttggnagagacgggagtttta

SEQ ID NO: 422070 - DNA, 718 bp, Homo sapiens
ggcacggtctcgtccagcgagtagtaacctggcgcgttcggtgcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccaaaaaaaaaaaaaaacaaaaaaaaaactcggggcacaagttgaacggtatggccaaatatgtcggcgctaatatatatatctgccagggggccgagcgtgatggctcaccacctgtatattccgcacttggggacgtcaaggaagcaaaatacgaacccaaagttagaaatcttgccagggaaatctgtttacaaaatacgggcgatacattcgatacccctctggaaggtggcaca

SEQ ID NO: 422071 - DNA, 493 bp, Homo sapiens
  misc_feature (35)..(35): n is a, c, g, or t
tactactattaaattcgcggccgcgtcgactacgnctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccaatgtttcccaggctgatcttgaactcctggcctcaagcgatcctcctg

SEQ ID NO: 422072 - DNA, 480 bp, Homo sapiens
gacttgctgtgttgcccaggctgatctcgaactcctgggctcaagcgatctgcccgcctctgcttcccaaaatgctgggatcacacacgtgacccaccgcgcccggcctttattattaaatttaattaattaattgatttcctttcctttttcccccccaagcaacccgactccgagaatggacgtttcatttattcatttactcaccaaatgtttactaagagcctactatgagtcaagcactatgtgtcagatcctgagaataaagcagtgagcaacagaagatccctgccctccagtagctagcattctatggggactcggacaacaaaccagaataagtaaataaaataaattacctgtcggcgccacaaaagcagtgggatgagggaggaaatgcggagtgcctgaggggcgtggctgccatattaaagaagatcacgaggcagtaacatttgcagcagtcctcatttggaacgg

SEQ ID NO: 422073 - DNA, 627 bp, Homo sapiens
tcacatgcacatacgcacacactccccacagatgtcatacacatacccatgcaccttacatacacatcacgctacacacatctacagacactacaccatacatacatacaaagcacacacttacacataccacacacacagacacagcccacatcatacgcccaggtatgcatacctgggcgtatgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcacca

SEQ ID NO: 422074 - DNA, 766 bp, Homo sapiens
agacgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccaaaaaaaaaaaaaaacaaaaaaaaaactcggggcacaagttgaacggtatggccaaatatgtcggcgctaatatatatatctgccagggggccgagcgtgatggctcaccacctgtatattccgcacttggggacgtcaaggaagcaaaatacgaacccaaagttagaaatcttgccagggaaatctgtttacaaaatacgggcgatacattcgatacccctctggaaggtggcaca

SEQ ID NO: 422075 - DNA, 578 bp, Homo sapiens
agacgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccaatgtttcccaggctgatcttgaactcctggcctcaagcgatcctcctg

SEQ ID NO: 422076 - DNA, 793 bp, Homo sapiens
agacgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcagcaacccgactccgagaatggacgtttcatttattcatttactcaccaaatgtttactaagagcctactatgagtcaagcactatgtgtcagatcctgagaataaagcagtgagcaacagaagatccctgccctccagtagctagcattctatggggactcggacaacaaaccagaataagtaaataaaataaattacctgtcggcgccacaaaagcagtgggatgagggaggaaatgcggagtgcctgaggggcgtggctgccatattaaagaagatcacgaggcagtaacatttgcagcagtcctcatttggaacgg

SEQ ID NO: 422077 - DNA, 625 bp, Homo sapiens
gtatcaacgcagagtggccattatgggggggcggacggaagatggcgtccgccacccgtctcatccagcggctgcggaactgggcgtccgggcatgacctgcaggggaagctgcagctacgctaccaggagatctccaagcgtagaaacggggtttcaccatgttggccagtctggtctcgaactcctgacctcataatccgcctgcctcggcctcccaaagtgctgggattacagaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcacca

SEQ ID NO: 422078 - DNA, 511 bp, Homo sapiens
gtcgccgttcactatcgcgcacgtacgatgagcgtcggcccccgttctcatccaggtcgtctgcataacttggcgctccgtttaaaaccctgagggctgagtcctaccaggagatctcacgtaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcacca

SEQ ID NO: 422079 - DNA, 401 bp, Homo sapiens
gtggggactcctgagtaggctggggcctcaggaacagaagaggggatgggctggtgctatatctggggcagaaggaaccagatttgggttattatctgcctgggagagcttaaggagggcatgaaagaaagggaaaaagacaaacagtgttggatttgcaactggtcttaacaaaaagaattcacaaagcattttatatttttaaaaattctggcttgtactcatttataaactaaaaaaaaataactatatgatgcaggcaacgtggtgagaccccatccctacaaaacatgaaaaaaattatccaggtgtggtggcacatacctgtagtcgtagatacttgggaggctgaggtggtaggatcacttgagcccaggaggttcaggctgcaatgagccatg

SEQ ID NO: 422080 - DNA, 786 bp, Homo sapiens
cgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagagccctgcattttaacttccctatcagaagcgagaaaaatagttatcattttgagagggcttactctatgccaagccctgagaaaactctttacgtggattatctcgtttaatttcacaacatccttttaagcccctgcccttgatggatcagctggcaccacccagattgataaactggctcgtctgatcttgtggcccccacccaggaactgactgggcactagaaaacagcttcaacatcctgtgatttcatccctgaccaatcagcactcctgtctcactggcttcccccaacccaccaagttgtccttaaaactctgctccctgaatggtcggggagactgatttcagtaatagtaaaactctggtctcctgc

SEQ ID NO: 422081 - DNA, 2451 bp, Homo sapiens
cgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttcagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtctttttttgaaactgtcctgctctgtcacccatcctagagtgcagtagtgtgatcatggctcactgtagccacaacctctcaggctcaagtgatcctcttaccttagcctcctgcgtggctgggactacagatgtttgccaccatgcccgcctcattttttttctttttttatagagatgagattttactatgtcgcccagactggtctcaaactcctggcctcaagcaatcctcacgcctcagcctcccaaagtgttgatgagccactgtaccccgataccactgtataaaaaatttaaaaaaaattgtgagtgctattgtacatggcaaagtttcaaagagctcttggccatccctcaccaaactttggcaaaagatggtgttagtccccttctccagggcacatgagaaaaacaggcctaacatcaggtctcagcggttcctctcacaggccttggcttggaaggctggagcttcggaccaaggcccagccctgtcacctcctcttcatgtgatgtggacccctgggagcatcagtgtcctcatctgtccaatgacagcccttttctcacagagttattgtgaagattcaacaatttcttggcatagtgcctggcacatggtgtgtgcttagcgcaaatggcagctctcatcatgaatgatagactctttcaccctgctggtcccaggtcggcacacacatcctcataatggcatttctcctttctgtgcacagcactttattgttacaaagtactcttccaaaaagttaccctgtgtgtaaaaaaaaaaaaaa

SEQ ID NO: 422082 - DNA, 2341 bp, Homo sapiens
cgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttcagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtctttttttgaaactgtcctgctctgtcacccatcctagagtgcagtagtgtgatcatggctcactgtagccacaacctctcaggctcaagtgatcctcttaccttagcctcctgcgtggctgggactacagatgtttgccaccatgcccgcctcattttttttctttttttatagagatgagattttactatgtcgcccagactggtctcaaactcctggcctcaagcaatcctcacgcctcagcctcccaaagtgttgatgagccactgtaccccgataccactgtataaaaaatttaaaaaaaattgtgagtgctattgtacatggcaaagtttcaaagagctcttggccatccctcaccaaactttggcaaaagatggtgttagtccccttctccagggcacatgagaaaaacaggcctaacatcaggtctcagcggttcctctcacaggccttggcttggaaggctggagcttcggaccaaggcccagccctgtcacctcctcttcatgtgatgtggacccctgggagcatcagtgtcctcatctgtccaatgacagcccttttctcacagagttattgtgaagattcaacaatttcttggcatagtgcctggcacatggtgtgtgcttagcgcaaatggcagctctcatcatgaatgatagactctttcaccctgctggtcccaggtcggcacacacatcctcataatggcatttctcctttctgtgcacagcactttattgttacaaagtactcttccaaaaagttaccctgtgtgtaaaaaaaaaaaaaa

SEQ ID NO: 422083 - DNA, 1579 bp, Homo sapiens
cgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacacccctgcccttgatggatcagctggcaccacccagattgataaactggctcgtctgatcttgtggcccccacccaggaactgactgggcactagaaaacagcttcaacatcctgtgatttcatccctgaccaatcagcactcctgtctcactggcttcccccaacccaccaagttgtccttaaaactctgctccctgaatggtcggggagactgatttcagtaatagtaaaactctggtctcctgc

SEQ ID NO: 422084 - DNA, 2618 bp, Homo sapiens
cgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagctttgtttaagactgagaaagtgagggtccgagagtctaatgaatgctctgggcacccaggccgcacctgaggagcaccgacgactgcacggtctgcggcgcgggaagcagatctgcggctgaacctctaccccaattacttagcggcgactgagcctatcgagcagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttcagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtctttttttgaaactgtcctgctctgtcacccatcctagagtgcagtagtgtgatcatggctcactgtagccacaacctctcaggctcaagtgatcctcttaccttagcctcctgcgtggctgggactacagatgtttgccaccatgcccgcctcattttttttctttttttatagagatgagattttactatgtcgcccagactggtctcaaactcctggcctcaagcaatcctcacgcctcagcctcccaaagtgttgatgagccactgtaccccgataccactgtataaaaaatttaaaaaaaattgtgagtgctattgtacatggcaaagtttcaaagagctcttggccatccctcaccaaactttggcaaaagatggtgttagtccccttctccagggcacatgagaaaaacaggcctaacatcaggtctcagcggttcctctcacaggccttggcttggaaggctggagcttcggaccaaggcccagccctgtcacctcctcttcatgtgatgtggacccctgggagcatcagtgtcctcatctgtccaatgacagcccttttctcacagagttattgtgaagattcaacaatttcttggcatagtgcctggcacatggtgtgtgcttagcgcaaatggcagctctcatcatgaatgatagactctttcaccctgctggtcccaggtcggcacacacatcctcataatggcatttctcctttctgtgcacagcactttattgttacaaagtactcttccaaaaagttaccctgtgtgtaaaaaaaaaaaaaa

SEQ ID NO: 422085 - DNA, 1763 bp, Homo sapiens
cgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttcagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtctttttttgaaactgtcctgctctgtcacccatcctagagtgcagtagttgagccaagatcaggacattgcactccagcctgggcaacagagcaagactccatctcaaa

SEQ ID NO: 422086 - DNA, 1605 bp, Homo sapiens
  misc_feature (9)..(9): n is a, c, g, or t
  misc_feature (17)..(17): n is a, c, g, or t
  misc_feature (21)..(21): n is a, c, g, or t
  misc_feature (23)..(23): n is a, c, g, or t
tcgtggaanttcggcanaaanancaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422087 - DNA, 949 bp, Homo sapiens
  misc_feature (795)..(795): n is a, c, g, or t
ataagttatattaattaattgtttatgttgtggtatactgatttgtatagttactgtgaggtatagacagattaatagtagatcgtaaggaagttagtgaatatgttttttgcgatgttttaagtggtgaatataggtatggagaggtgttgctgatggtttgtaattgtattgactgatggtatataatattaagatatatgtatatgtgggtgggtattatctaatatgtgagtggggcgatgttgggtttggggggttttttatttcggataggccctccctcgggtatataaaaaaatatttgtttccaagagaagatgcacatatatctctccactatgattgtgccacacaacatttgtttcacaggccgccgtcgcgcggcacataatagccccacgctgtatgtgtgtaaacaccacctgtaaaacacactctgtctaaaaagttttataatattgtccccttaggagaggcctcttaaataatctccgttatagagtgtgtattttgtgtcgcccctatataagtgtttccctccccccccagcaagatgtataagaggttcccctctcacacaaagttctcgccacaccgtgtgtgcaccgtgtgtttccccacgttccccagaccgctgtttgtataaacacgccgcgcgcgcccctgtgcgctatgtggtctatataaataacacaggcctcccactatatatatgggggcgccaccctcttgtggagccaaaaaaacctggggagagcggcgcgagaaacctggggcgccccccgagagagngagagaaattttatgagagcgcgcgcgcccccccttttttttttttttttttttatgtttgtttgttttttctccttagcagtaggacttgatattttcaattttggaagaactaaaagatgaataaactgggttttttttgttgtttgttttt

SEQ ID NO: 422088 - DNA, 313 bp, Homo sapiens
cttactttcttttagtaagaaaattgttagagaaaataaagaaggataggtgttttttatcctaattattgtcattttcatttttgatatttacttagacttaaaactcattgaacaaatgttacttttaaagtctctttagggcaggcataatggctcacacctgtaatcccagcacaattagaggccaaggtgggaggaacacttgaggccaggaactcaagaccagtctgggcaacatagcaagaacctatctctcttttttttattttttattttttaagataatgtctttttaaatagtttattttaa

SEQ ID NO: 422089 - DNA, 4677 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422090 - DNA, 4662 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtagggttaggtctacctgggcgtgtagagctagactatgcagagatggaacttgttg

SEQ ID NO: 422091 - DNA, 4532 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcacgacatccaatcttcgggttctccgcgtcgtctgtttaccctctagagtcagctatg

SEQ ID NO: 422092 - DNA, 4267 bp, Homo sapiens
tggcgttcagaggatccccttattttccttctttatgtcgtatcaggggtgtgatgaagaaatgtttatgccaaatcaacggccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422093 - DNA, 1716 bp, Homo sapiens
acagcgaggcgagaggggaaaaactggctaggtacgaggcttcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422094 - DNA, 1745 bp, Homo sapiens
atagccacatattcatgtaatactcaagaattagcctactcagtttccaaacctaaatcctataatactttaattttctaggcttcttccaggttaggcatgtctttataatgctaatctagttactctgaagccaaaccccaaacaaacgttttaaagcttaaaaggaaataaatattaactgctgtgttccaagcattgggaataggtagttttcataggttaccttatttaacccttaaataattctcccttttgtaaataaaccaaggttcagaaagtacttgcccaatattaaaacttgggtctgattccaaagtgtattctctgtactatctcatgctatccagtaatattaggtacctaaagcttacctattgctaactaataatgcctcttctatttagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422095 - DNA, 1174 bp, Homo sapiens
gaaaattttaaatgaaaacgaaaggaaaaatacagtttctatgtcatgtaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422096 - DNA, 3399 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagacgcaggaactggtttcaagaagcaggaactgg

SEQ ID NO: 422097 - DNA, 2844 bp, Homo sapiens
  misc_feature (2658)..(2658): n is a, c, g, or t
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaaattgcctccttatttatcaacatctttttcctccctttccctgagagctcacagtacaatgtttcagaagccccatttgcacaggttttcagcaactcagaatgctctacttctttttctttgagaaaggattaagatanactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaaaaaaaaaaaa

SEQ ID NO: 422098 - DNA, 1196 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcgggaattcccgggttctgtgcctcacccttttcgttgctcccgaatcattcaccggaggcggccacgaacgctgccccttaacagggaatcccccgcattcaccctgtcctgcggccatcaccatcttccccgcgtgccagccttggtcatgcatagcagcacctctcgcagtctcttcccgccctagaagaggcaacatccttccctcctactccgtggtcacgtcttgctgccctcccctgccgtgttctcacgcactcgctctgtccctccagaaccacaatattccacccctggtcccgccaggattataaccgtcttcgtaaaggagagatggaagggcaaggaggatgtcaatcgggcttttagcgtttatcgtttgcggggcttttgctggagttaaaaaaagaaatactgctcacgcgcaaccgcctcatgttctaggccctgctgtgggttacagagagggacctaacgctgaaagcctgcaggcattagtaataacaaaacaaaacaaaacgatgcctaaaaccttattagttccttggtagcgtatccggggcacgtgttcattaaaagagctgtggcagttcccagttttttaaagattcggcagttttgctgctctaaaaacgtccacagttaaaacttatttttatgatgttaacttactaattgagcaaacatttggttgcattctgtgatgcagtctgagttggctagcttaagtcttgcccctgaaccctgtcatcaagggaagatacagctaataaagatttttttttaacct

SEQ ID NO: 422099 - DNA, 1309 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcgggaattcccgggttctgtgcctcacccttttcgttgctcccgaatcattcaccggaggcggccacgaacgctgccccttaacagggaatcccccgcattcaccctgtcctgcggccatcaccatcttccccgcgtgccagccttggtcatgcatagcagcacctctcgcagtctcttcccgccctagaagaggcaacatccttccctcctactccgtggtcacgtcttgctgccctcccctgccgtgttctcacgcactcgctctgtccctccagaaccacaatattccacccctggtcccgccaggattataaccgtcttcgtaaaggagagatggaagggcaaggaggatgtcaatcgggcttttagcgtttatcgtttgcggggcttttgctggagttaaaaaaagaaatactgctcacgcgcaaccgcctcatgttctaggccctgctgtgggttacagagagggacctaacgctgaaagcctgcaggcattagtaataacaaaacaaaacaaaacgatgcctaaaaccttattagttccttggtagcgtatccggggcacgtgttcattaaaagagctgtggcagttcccagttttttaaagattcggcagttttgctgctctaaaaacgtccacagttaaaacttatttttatgatgttaacttactaattgagcaaacatttggttgcattctgtgatgcagtctgagttggctagcttaagtcttgcccctgaaccctgtcatcaagggaagatacagctaataaagatttttttttaacctgaaaaacgttttgagaaaaatgatcagctctcatttcagcattgtaaattatctttcaaactggtcatctactaaaaccaagccattaaaattggtcgtttccttgccattca

SEQ ID NO: 422100 - DNA, 245 bp, Homo sapiens
taaggtaaatgtcaaaaaaaaatcagtattatgctctaactcaccaggggagtgatgctgaagaaggggattcagagtctgaaattgaagatgagacttttaatccttcagaagatgactatgaagaggaagaggaggacagtgatgaagattattcatcagaagcagaagagtcaggttagtcttacagagcaaagttcgtcctggcttcctaatctaatgtcatttctgaaaactactttttt

SEQ ID NO: 422101 - DNA, 660 bp, Homo sapiens
tttattttttattttttaagataatgtctttttaaatagtttattttaaatggttccttcacatagtttccttgagtttattctccttgagggatgatttttgtatcttgcagatcctttttctgtggcttcttagtatgttgtactgcctcagtctttcaaaaaaaaaaccaaaaaacagcttaagttatcttttatgtagtgatttagatcatgaaagttatttgaaatattattgctttgggggaaatacttatatgctaatgattcagtttctccctgacagccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaagtaagtaaatctgccatcagtctcccatttagcccatgagccctgttttatagaatttgaatgtggtatgttgtgcataaaatctactgatatacttaaagtgagactgccttttggttgttacagaccaggacttgaaaacttgagatctattagataacggagctgttcactttttcttgaattcccaacaatagcttgtgc

SEQ ID NO: 422102 - DNA, 4627 bp, Homo sapiens
ctgaattgaacaacagtcttcatccaacactccaaaccagttggcagggtaggacccttggtgtggggtgttggatgaagactgttgttcaattcaggggccggtggggctgagggtttctgtgggggaagacctgataccgccaggccccgaagcccttcaggagccagtcggtgggggtcctcacttacagggtaaaaacggggtctctgaggtgggccctgaccaggaaacgctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422103 - DNA, 4709 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttttttttttttttttttttttttttttttatgag

SEQ ID NO: 422104 - DNA, 4506 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422105 - DNA, 3095 bp, Homo sapiens
caggaatgaaggcaacatctttcccaaccctgaagacggatatgggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccgcatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggagggcattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422106 - DNA, 2039 bp, Homo sapiens
atgatttttgtatcttgcagatcctttttctgtggcttcttagtatgttgtactgcctcagtctttcaaaaaaaaaaccaaaaaacagcttaagttatcttttatgtagtgatttagatcatgaaagttatttgaaatattattgctttgggggaaatacttatatgctaatgattcagtttctccctgacagccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgttttt

SEQ ID NO: 422107 - DNA, 1566 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaagatggttccgcatcacttaggatctccagactgattacagaggggacaggcgaagaaaactatgccgttcattggcacattgtggttatgccactcgtctctttgg

SEQ ID NO: 422108 - DNA, 14138 bp, Homo sapiens
  misc_feature (1330)..(1330): n is a, c, g, or t
  misc_feature (2427)..(2427): n is a, c, g, or t
  misc_feature (2585)..(2585): n is a, c, g, or t
  misc_feature (3378)..(3378): n is a, c, g, or t
  misc_feature (5381)..(5381): n is a, c, g, or t
  misc_feature (6137)..(6137): n is a, c, g, or t
gcactgcagcgccagcgtccgagcgggcggccgagctcccggagcggcctggccccgagccccgagcgggcgtcgctcagcagcaggtcgcggccgcgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctngacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccnggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggntgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtgganctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtgnccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcagntgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggcagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgcaa

SEQ ID NO: 422109 - DNA, 14221 bp, Homo sapiens
  misc_feature (1330)..(1330): n is a, c, g, or t
  misc_feature (2427)..(2427): n is a, c, g, or t
  misc_feature (2585)..(2585): n is a, c, g, or t
  misc_feature (3378)..(3378): n is a, c, g, or t
  misc_feature (5381)..(5381): n is a, c, g, or t
  misc_feature (6137)..(6137): n is a, c, g, or t
gcactgcagcgccagcgtccgagcgggcggccgagctcccggagcggcctggccccgagccccgagcgggcgtcgctcagcagcaggtcgcggccgcgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctngacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccnggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggntgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtgganctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtgnccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcagntgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggcagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgcaaaaaaaaaaataaaataattatctttagggggggcccggtccccatttccccctttagtgagtcgttttacaataccactggcc

SEQ ID NO: 422110 - DNA, 14285 bp, Homo sapiens
  misc_feature (1330)..(1330): n is a, c, g, or t
  misc_feature (2427)..(2427): n is a, c, g, or t
  misc_feature (2585)..(2585): n is a, c, g, or t
  misc_feature (3378)..(3378): n is a, c, g, or t
  misc_feature (5381)..(5381): n is a, c, g, or t
  misc_feature (6137)..(6137): n is a, c, g, or t
gcactgcagcgccagcgtccgagcgggcggccgagctcccggagcggcctggccccgagccccgagcgggcgtcgctcagcagcaggtcgcggccgcgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctngacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccnggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggntgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtgganctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtgnccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcagntgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtacgcccgtccccggccagaccccgcgcctcccaccggcagcgtcccgccccctcgcggggccccgccccggcagcgtctcacccctcgcagcgccccgccccctcgcagccgtccctcccgccctcctgaccgcgccccccacaggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggcagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgcaa

SEQ ID NO: 422111 - DNA, 13572 bp, Homo sapiens
  misc_feature (1330)..(1330): n is a, c, g, or t
  misc_feature (2427)..(2427): n is a, c, g, or t
  misc_feature (2585)..(2585): n is a, c, g, or t
  misc_feature (3378)..(3378): n is a, c, g, or t
  misc_feature (5381)..(5381): n is a, c, g, or t
  misc_feature (6137)..(6137): n is a, c, g, or t
gcactgcagcgccagcgtccgagcgggcggccgagctcccggagcggcctggccccgagccccgagcgggcgtcgctcagcagcaggtcgcggccgcgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctngacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccnggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggntgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtgganctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtgnccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcagntgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggcagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggaatagctagtcaccaccaagccagcgtagaacgcgtggatgtatacctactgccgagttcagttatcggtaatgcccagcctgtttccacgtttatgtct

SEQ ID NO: 422112 - DNA, 934 bp, Homo sapiens
gctgaccacagggcccccccgtccaccagagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtacgggcatccggtgcactggtctgtcttctgggctttagttttgcctttagtccagccagaccctaggggacatgtggacatgtgtagatacctttgtggctgctagaactggaggtaggtgctgctggcatcagtaggcagaggggagggacacaggtccgtgtcttgcagtgcacaggacgggcccatgacagacaactgtctgccccagaacatccccaggataaggctgagaagcccaggtctagccgtggccagcagggcagtgggagccatgttccctgggtctctggtggccgctcactcgaggcgggcatggggcagtaggggctggagcgtgtgactgatgctgtggcaggtctgaggagctctggccatggatggcccacgtgctgctgccctacgtccacgggaaccagtccagcccagagctggggcccccacggctgcggcaggtgcggctgcaggaaggtgagctggcagggcgtgccccaagacttaaatcgttcctcttgttgagagagcagcctttagcggagctctggcatcagccctgctccctagctgtgtgacctttgccctcttaacaccgccgtttccttctctgtatatgagagatggtaacgttgtctaattgatggctgctgggagggttccctggggtggcgccgaaccagagctcaggcgagctggccagcaggaaacactcctgttgggttttgatgaggccctggccccggcctggggctctgtgtgtttcag

SEQ ID NO: 422113 - DNA, 284 bp, Homo sapiens
gtttgctcggaagcccagggtgtccgtgcgtgactggacgggggtgggctgtgtgtgtgacacatcccctggtaccttgctgacccgcgccacctgcagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcag

SEQ ID NO: 422114 - DNA, 426 bp, Homo sapiens
ttttagctggtactaggtttgctttacagatggggaaactgaggcacagagaggttgaggcattagtagtactacatggctggctggagagccggacagtgagtgtcccagcccgggcttggctcccatggcatgcagagccccgggcacctcctctcctctgtgccccgcgtgggactctccagcccgacgggaggtgtgtccaggaggcgacaggctaagggcagagtcctccacagagcccaggctgacaccattccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggggtggggagggga

SEQ ID NO: 422115 - DNA, 14086 bp, Homo sapiens
  misc_feature (1330)..(1330): n is a, c, g, or t
  misc_feature (2427)..(2427): n is a, c, g, or t
  misc_feature (2585)..(2585): n is a, c, g, or t
  misc_feature (3378)..(3378): n is a, c, g, or t
  misc_feature (5381)..(5381): n is a, c, g, or t
  misc_feature (6137)..(6137): n is a, c, g, or t
gcactgcagcgccagcgtccgagcgggcggccgagctcccggagcggcctggccccgagccccgagcgggcgtcgctcagcagcaggtcgcggccgcgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctngacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccnggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggntgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtgganctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtgnccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcagntgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctggggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggcagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgcaa

SEQ ID NO: 422116 - DNA, 11413 bp, Homo sapiens
  misc_feature (1330)..(1330): n is a, c, g, or t
  misc_feature (2427)..(2427): n is a, c, g, or t
  misc_feature (2585)..(2585): n is a, c, g, or t
  misc_feature (3378)..(3378): n is a, c, g, or t
  misc_feature (5381)..(5381): n is a, c, g, or t
  misc_feature (6137)..(6137): n is a, c, g, or t
gcactgcagcgccagcgtccgagcgggcggccgagctcccggagcggcctggccccgagccccgagcgggcgtcgctcagcagcaggtcgcggccgcgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctngacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccnggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggntgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtgganctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtgnccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcagntgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcgggtgagcctgggtgcggcctgtgcccctgccacctccgtctcttgtctcccacctcccacccatgcacgcaggacactcctgtccccctttcctcacctcagaaggcccttaggggttcaatgctctgcagcctttgcccggtctccctcctaccccacgccccccacttgctgccccagtccctgccag

SEQ ID NO: 422117 - DNA, 456 bp, Homo sapiens
gacggtggcctgtgggcaaatcagggccccaacaccctcccctcctcacagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgtgcaccagacacacccagcctgcaggcccctcccacgtccttgccacctctgacctccgacctctgcagtgccctcggc

SEQ ID NO: 422118 - DNA, 6635 bp, Homo sapiens
  misc_feature (319)..(319): n is a, c, g, or t
  misc_feature (4401)..(4401): n is a, c, g, or t
acagataggatcttgctgttgcctaggctggagtgcagtggcacaatcatagctcactgcagcttcgaactcctgggctcaagcaatcctcctgcctcagcctcctgagtagctgagactacaggcacgtgtcaccaagcccagctaagttttttattttttgtagagatgaggtctcactatcttgcccaggttggtctccaactcctggcctcactcaatcctcctgcctcagcctcccaaaacgctggagttacaggtgtgagccactgcacctggcctttgtattttagtataaaatgtgctttggatagaatcnttgctttttctagcttgtggcctttttttttttaagtatctgtataaggcagttggaaaacaagttcaagctggacactcttgagtccagtcctcatgttttcagcccactgttgcacccagttcgtgtgggtcaggcctgggcccatggaatgagtgtatctcccagtaaggaagtctgctatctgacaaaaacagcagaagctgagagctcaagggatacaaaatagattgcagttgagggttaggaaggaggctgcatctgtgtgcctatttcccctggcaagcctctacatcgaagagcagcagagcagccctgtcgtgccattgagctgacagtgccacatatgcaaagataaagccatagaggcaggacacttgaggggcacctctcagtctgccctgaaccatctgccatcttgaacagggagacaccatggctctggggcagttttcctccataagaactcacttggagatattgcccttctgtttaataccatcctctagccaaataattcaagaaggtggcattcagtcatatactgttttcagttctaaagaaaagttgaagtgatggtagtaaattgtggactaaagacagcttaatagcatactgatgtggcctgtcttctctttcaagctttgtcatttctaattaaggtttaaatggagaaactatcattttgtagttacctgagatttttcagttctaaagtaaaaacaaaaaaacaaacaaaaaccaacacgtttaaaaatccctccccaagtaaccagcagtcagtttgatcattatggaagagaattcagatggcaatgtatttgcaattgaggagagagtagccaatcacacttaatgaaacagaccgtttacacttggaatggcctggagtaagttgatattcagcgtctacactcaaatatcaatcttggatttggaaatttggcttgaccactgtaaagtctgggaagatgaaatgcctaaattctgggttccataacttttcatctgacagctggtggtgccgaaccccgtccccaattacctaggtcatctttaaggtcaatgtcagcattggtaggattgattatggcctccacctcaaagccggctaaattactgatttcactgtgaataaggttcagctgcaaagaaaagcatgaggtgggaaataacaggagagctgggaagtctcagagaaggagccttgggatacaggtaaaggacagtggacactccaagtgcacgaggcacaaaagggaagcagggagttgctggctcaaatgaacccatttcaaacataagactcaaatgctgctcgggatgcgggagcaagcaaactaggatgaatgttcagagcccgtgggtggcacctgggacaaaaggaagcacaagccacagtggacgaggagatcagctttcctttaaagggacttgtgatctgggggccaaagtaaggcagctatcaggacctagaatgagtactcattgctgagggttgggggctggtggatgtgactgtcctcatccttgagcactaggctggtgctaacatcctacctggcttgggcaaacccctaagggctctgccattgtcttccaagtgactatgggcctttaaggctgtccccatcactgtgactgctggctggcttccctgccctgctcagggtggcaagaagtgagaatagtctcttgcttagtaacatttaatttacgtgcccattagtcatgtaatgctgaagttccatggtgaaacccaggggaggaaggttctccagcaagacaatgtgtcttttaaatggttttcaccttgttggtcaggttgctctgagactcaatgggtggcttattgagcattttccttaagtgttatatccacccagtgaatttgttctttctgaagagccactgaatgggtgtcccccagccactgttattctgttacaatggcaaccctggcatctgagtattcgaagaatactgagttcgaaattctgtcagaggggcaaggggaattaatgggcctaggactgctgtcccaggtcctactattccccttgcttttctttaggtattgcaggaaagcttgctcttgcacatgctctcacaatgacattgctcactcttcagtaacataaattcctaacacctgcagacaagtgcaatgcctgagtagccctagcagagctggtgctcaagactatgacctaggccagaatagtggctgcagtctgcagggtttaccagggcatgaggctttgtccaggagctcacccaggagagggctgtgcacaagacacttggcagggaagctcctggcaacagagcaagttgctgcatttctagggccaaacattttgttgaaaacaaaaccaaacaacctggcactccagaagtatcggaaatataaacccacatttttgattcccagaaacagtcagattctcaaagagggatgtgcttacactaagagtcatcctctgggaggaaacagttgtggaattaagttttgtcaaacagccaaggaagaattctggccagggcagtggacttcatttttggttaaagactcagagaagaggaccaagtattattcatatggactttctgggttattgctcctcgcactatagagtgatttagaggccacccacacccttgaagctgaaggaagccatgggggtgatctcacaaagcgaagctctcagcagctcagagccctggcaccaggacagaggcacagaaaagagacagcatgggggctggggcctgactgctgccactggggagtaggggtgtgggtgggcacagagtcgggggccttagggtaaggcaagtgaactctcaggatttagaacaaggcaaaggattttactctattatttagttctgcatttggctccaagcaaatgctatttacaaaaactcaaattaagccaatactccccaccacacaccaccaaaacacaccccacacagtgtgaagaggcaggaggttggtgaggaaggcaggcaaaggagaaaaagactcgatctactcagtgtaatgtggatgtgtatgcttttaaggcacctataaattcctatgtttaaaacaatacatgttcaatccttaaaattcacgcaattttttccaattgtatagatgcttctggtgttatattcagaaatgtttcattggaaaagaagctattttggcgggctctgcttcagctagccaggaagaccccctcagtggcctgtatctgactctcttcgcgggagaaccacctgctctgtctaggggaatgggattctctgggggaaacttggatttgctgaaggaagggagcagttgcgaacagaactcaagctcatggagaattctcagcttcctttggactcactaccttcccttctgaccagaggcatccccactcttggaagtgcagactacagtacctcagggagccactactactcagcattgaggatttcctgccaaccaagtgctgtttcactcttcacatctgtggatgaggctagagctgtgattttccaactatgctctgctatgcactggggctcagcagaagtcctcagggtatgcagctgagccacaaaagtttttttgctgtaaaatgtgtacaaatatgtatttttaaacaatcttgactagaaagtgtgtgcttgggatgtgtgcatcaggggaagagaatgggaaggggagaagacaaattaattcaagtactttggaaggacaaatgggtaatcagcttggcaggtgggccagtgggcagaagctgacagtgagatgatcatgaacgaagacagtagctccactatacagaagaaagcccatgagcatagcgtgcaaatggaccaggtacacatgtgtctggacaggctcccactgtccagtcacaaatgaataagcgagatagagccaagacagaggtccagtcctaggaggccccagggtcccctcccaccagccagggtcagatccagtggggtttatcagccagaggggtgtgtgtccatctgaagtacatggcagagaagtggtccttgtgggttaggaaatcagatttctgggnactgtaaaaattcccaaaattagtctgattttctgggaggaataaggatcattaatggtttcagaatttgaataaggtgactgcttctttgtaccgtcgttaggaaagatggaaaactaagttttaaaccacagcatgaggaatttaaagcagctatgaagactgttagccactgaggaaagtaatcatagggcactgccagttatagagcagaagggggtccccgcgtggctgcacagttggcagaaagggtcgtagccaagggaccttcaagatcccttccagcactgggatccgataatcctaacctcactggctctgctgggccagcttctgatacaagcagtacccgagtcttccctgtggtgaggatgtccgtggaaacccttgttctttactcatggtatatgctcatcagagtataatctctttgaaggcaggagtgggtgtggccccctaaccctgagtgctgcacagtgcctaagccagtgctggggttcccctgggcatgtagagttagaactgaacatcaaacatccttagatataactcataaaatgactgcccctgcttgctttcctttaaggcattgttaatggaaatgccagagctcagaaattgagccctgggcctggcttgtatctgaggtggctcagagccaagctgtcctcgcctggatgggaggctggcccccaccatttagggcagggcaggaggcggtctgtcgatgatgacagggaaggagtgtctggatggacatgcagactgcctgacctgacctacttggctacaggaaatagtacattccttcttggttcttttaaaaaaatatgattagaaacccaattttagttaatgaaagtggctgttaaagatagtgcctgagtagtatgttaaatctagcctgtaactgtcagattttggtgtctctcattttctcataacagataaggaaggaagcctggctgaccacctaaaatgcagttattttcctgtccccaaagttcacttcaacgaggggaatgggaagggcaatgtcttccataggaccctttccagtctcctcctgagagctgtgtcttccctggggcacactccagggctggctcctgccctcacagctgtgctgtgtggctctccctgcatgcatgcatgcccaagctggatttctccagaggccttgggccgggcagaatctagtgtgtccagctagaaagagccccacaaagataaggacatggatagatactgctggatgtccagatggtcgatagctgagccattccttcatggctttgtcagtttcctaaactgtctcagaagccagtcctcagccatagtggggggaaggggtgaatggtttttctcctcactgatgcttcaacttcaagagctccctttctcctcacagttcttccagctcccgggagaagggtatgtggatcaaagggagaaaacccatggtacgttatgcccgccttgaatggcttgcgagctggggttgccatcttgatcatttgggaggtaaggagactcatcacagcctcagactgccttcctaactccttcaaataatactgactctgacaaggaaacttaaatcatttaccatttaccattaagtcagtgttaccactgacacattagacacattagaaatgttttttctgaaaattttaaaacctctgaaaaaaggctgcaaatcttggctgaacacaaagcaaaagcatttagttgactcagattcacagcactgatttcttttttaaaacaattcaacaatgtgtgtgaacattgggcaaaatcagagagtaatggctatgatgactcctgagacttcagtatgtgaaatacatcattaacatcaatggtcaggctcctaagcctgggccatgcttcctgagtagcttagcaaccatgccttacagggctgtagcatgcacaatatcacctttctccaccccagcttgcttgcaatcttcaagcactggtttcagtgtcacagatagaaaaatgagattcataggacacagggtaccatatagtcaccattctaaagtaccccttttgaaacatttcctaaaatccaagtcaaaattaatgtctataatattttaaatgtgctttttgtaaaaactgtgtgttagtttcatgatttttgccttttttacactatatgccatgattttcacctgacagtaatagccaataaaaagccagaaagtaatgcttca

SEQ ID NO: 422119 - DNA, 2867 bp, Homo sapiens
  misc_feature (319)..(319): n is a, c, g, or t
acagataggatcttgctgttgcctaggctggagtgcagtggcacaatcatagctcactgcagcttcgaactcctgggctcaagcaatcctcctgcctcagcctcctgagtagctgagactacaggcacgtgtcaccaagcccagctaagttttttattttttgtagagatgaggtctcactatcttgcccaggttggtctccaactcctggcctcactcaatcctcctgcctcagcctcccaaaacgctggagttacaggtgtgagccactgcacctggcctttgtattttagtataaaatgtgctttggatagaatcnttgctttttctagcttgtggcctttttttttttaagtatctgtataaggcagttggaaaacaagttcaagctggacactcttgagtccagtcctcatgttttcagcccactgttgcacccagttcgtgtgggtcaggcctgggcccatggaatgagtgtatctcccagtaaggaagtctgctatctgacaaaaacagcagaagctgagagctcaagggatacaaaatagattgcagttgagggttaggaaggaggctgcatctgtgtgcctatttcccctggcaagcctctacatcgaagagcagcagagcagccctgtcgtgccattgagctgacagtgccacatatgcaaagataaagccatagaggcaggacacttgaggggcacctctcagtctgccctgaaccatctgccatcttgaacagggagacaccatggctctggggcagttttcctccataagaactcacttggagatattgcccttctgtttaataccatcctctagccaaataattcaagaaggtggcattcagtcatatactgttttcagttctaaagaaaagttgaagtgatggtagtaaattgtggactaaagacagcttaatagcatactgatgtggcctgtcttctctttcaagctttgtcatttctaattaaggtttaaatggagaaactatcattttgtagttacctgagatttttcagttctaaagtaaaaacaaaaaaacaaacaaaaaccaacacgtttaaaaatccctccccaagtaaccagcagtcagtttgatcattatggaagagaattcagatggcaatgtatttgcaattgaggagagagtagccaatcacacttaatgaaacagaccgtttacacttggaatggcctggagtaagttgatattcagcgtctacactcaaatatcaatcttggatttggaaatttggcttgaccactgtaaagtctgggaagatgaaatgcctaaattctgggttccataacttttcatctgacagctggtggtgccgaaccccgtccccaattacctaggtcatctttaaggtcaatgtcagcattggtaggattgattatggcctccacctcaaagccggctaaattactgatttcactgtgaataaggttcagctgcaaagaaaagcatgaggtgggaaataacaggagagctgggaagtctcagagaaggagccttgggatacaggtaaaggacagtggacactccaagtgcacgaggcacaaaagggaagcagggagttgctggctcaaatgaacccatttcaaacataagactcaaatgctgctcgggatgcgggagcaagcaaactaggatgaatgttcagagcccgtgggtggcacctgggacaaaaggaagcacaagccacagtggacgaggagatcagctttcctttaaagggacttgtgatctgggggccaaagtaaggcagctatcaggacctagaatgagtactcattgctgagggttgggggctggtggatgtgactgtcctcatccttgagcactaggctggtgctaacatcctacctggcttgggcaaacccctaagggctctgccattgtcttccaagtgactatgggcctttaaggctgtccccatcactgtgactgctggctggcttccctgccctgctcagggtggcaagaagtgagaatagtctcttgcttagtaacatttaatttacgtgcccattagtcatgtaatgctgaagttccatggtgaaacccaggggaggaaggttctccagcaagacaatgtgtcttttaaatggttttcaccttgttggtcaggttgctctgagactcaatgggtggcttattgagcattttccttaagtgttatatccacccagtgaatttgttctttctgaagagccactgaatgggtgtcccccagccactgttattctgttacaatggcaaccctggcatctgagtattcgaagaatactgagttcgaaattctgtcagaggggcaaggggaattaatgggcctaggactgctgtcccaggtcctactattccccttgcttttctttaggtattgcaggaaagcttgctcttgcacatgctctcacaatgacattgctcactcttcagtaacataaattcctaacacctgcagacaagtgcaatgcctgagtagccctagcagagctggtgctcaagactatgacctaggccagaatagtggctgcagtctgcagggtttaccagggcatgaggctttgtccaggagctcacccaggagagggctgtgcacaagacacttggcagggaagctcctggcaacagagcaagttgctgcatttctagggccaaacattttgttgaaaacaaaaccaaacaacctggctctagacattaaaggacctgagatccgaactgggctcatcaagggcagcggcactgcagaggtggagctgaagatagcgcccactctcttaatcacgctggataacgcctacatggaaaagtgtgacgagacatcctgtggcatggactacaagataat

SEQ ID NO: 422120 - DNA, 2503 bp, Homo sapiens
ttttcctctttctttctttcaagagacggaaagagtcttctgtgtattttaggcaaatttaggttaaggtgtaagtgccctttgaagcaaaaagtgtccatgttttgctaacatatattttagctactctggcttggctgaggtcttcctagataatcaacatccctcaacagccttggcggtgagaaggcacgtgaaagctgccagcacatcccaggagccttggctgtggcggcttctccttggaaagctccacgcacccttctgccagggatcctgtcctgcagggatgacagacccagcagcctcggcagagggaatgaggctccagcagcttcatcagcaagtggccaggcccagccctaagtcacagactgtcagaaggggacaatggtaggagagagctgggctcagggtctggagcctgccacatgccacctgcacggctttggatacactccctccttcatctgtggaacggggaatggggataacaccctggcccaagggtcacacagaaccaaaaggaagctacagcctaaggaagaaaccctgctatgggactgtggctgctctggactgcgcaggctgccaggaaggaatggcggaggcagcctccgtgggccttgcacagagtgagagcaccacaattatgggccatgtgtgcgcagagagacacacccatgaccgatacgtaacaagcatgtgcccctacctgccgctgccgatggatggaaatgcaatggatttcagcttcttatcatcagccagggccaagcagtttttcactgtcttttccagaagttcttcacacttgtctgcaccccaaactggactattacagtggatcacaaacttggcaggcaggccatggcctgcgctgacagcagctagtggtgcggggatgaaacagaaacagtgagctctggttcactgcaaagcacaagatgccaaacacagacccactcccctgccacggtatatcttcctgggccctccaatgccctgtgtctgaggagttccacagctgtctgctgcgttgtgattccaacgtgagctggagccaagccacacccttggaaagttggcattatgatgtgtcaccaccaggaattttgaccaagttcgtagtaagcctctctccactctcagaaagcatacacggttctcccagaggcagagccttatccatcaaaactcaactgaacgcaaactcaacgtgtcagaacatttgcagcctcaaaataattgttttgggtttccaacccttcttcttcaagtcgactggtgtgctaattatcgacttgcacaccaatatgatatatttgtctctactatgatgtattctctaaatctcccaaacccaattcaggacaaagctactaggaaagcaactgctttaaatgatctgctaagcaacctgaccagcatctccactctgccattgtcttctccctgctgaggatggcctcactgtgtgaataacggatcctgtttatttgtggcagaattagattagtttttaaggaactgtgtttttcttttcctagaagaggggcccctttctagctatacatctccaccaaagacttgcctttcccttgccagatctaaggacacaggcctggggtctgccacaaactgcaaagtaccatgtctcccagagcatgttccagaacccctgtccacagatgctctgcaaagaaggtttccagggcactgggtttagctgcatgctacgcttctatacaagagcacaccagagtctccacaccactgctaaagtaaaacatccaaactttttgcatttggttggctatttctgaaactttttttttttttaaggaatatctgtccaaggggtatggtttgttatggtcgtgtcatagatactggagaaggagcgatttgtgggtagtgtctcatggtacagtggaaacagctcagtcacagggtgtgaatttgagtcctggctctgctttgtgactgggcttgagaactctgggctgacctataaaaacctgacattgggggttgaattaaaccagtgggtttgtccccatgagaagtcatggctaaactatgcatagaaaacgactggaaagaaacattaacagtgactatctttgcacagtggaacaggagtatgttttattcacctctttatactttcaaaaatattttaaagcagtttctaaaatagcccttaaaatcaagaacaaaagtgttattgaaacaagcaaaaatatcttgaaccatgctatacctaatgggtttgcatctgctgtggctgaggtttccccagcagagtttggtacatggcagcaccaggctgcctaccaggccttgtgccaagggctaccagcaggactcaagctggaaccccgatgggaaaggacccacaggctggtcaaacaggtgttttaaagggcctggggaaaggccagctgcccctggctaggtagttaaaactgtgtatgccttcccttgtacaatgtgggac

SEQ ID NO: 422121 - DNA, 3778 bp, Homo sapiens
  misc_feature (1544)..(1544): n is a, c, g, or t
ttttcctctttctttctttcaagagacggaaagagtcttctgtgtattttaggcaaatttaggttaaggtgtaagtgccctttgaagcaaaaagtgtccatgttttgctaacatatattttagctactctggcttggctgaggtcttcctagataatcaacatccctcaacagccttggcggtgagaaggcacgtgaaagctgccagcacatcccaggagccttggctgtggcggcttctccttggaaagctccacgcacccttctgccagggatcctgtcctgcagggatgacagacccagcagcctcggcagagggaatgaggctccagcagcttcatcagcaagtggccaggcccagccctaagtcacagactgtcagaaggggacaatggtaggagagagctgggctcagggtctggagcctgccacatgccacctgcacggctttggatacactccctccttcatctgtggaacggggaatggggataacaccctggcccaagggtcacacagaaccaaaaggaagctacagcctaaggaagaaaccctgctatgggactgtggctgctctggactgcgcaggctgccaggaaggaatggcggagatgcttctggtgttatattcagaaatgtttcattggaaaagaagctattttggcgggctctgcttcagctagccaggaagaccccctcagtggcctgtatctgactctcttcgcgggagaaccacctgctctgtctaggggaatgggattctctgggggaaacttggatttgctgaaggaagggagcagttgcgaacagaactcaagctcatggagaattctcagcttcctttggactcactaccttcccttctgaccagaggcatccccactcttggaagtgcagactacagtacctcagggagccactactactcagcattgaggatttcctgccaaccaagtgctgtttcactcttcacatctgtggatgaggctagagctgtgattttccaactatgctctgctatgcactggggctcagcagaagtcctcagggtatgcagctgagccacaaaagtttttttgctgtaaaatgtgtacaaatatgtatttttaaacaatcttgactagaaagtgtgtgcttgggatgtgtgcatcaggggaagagaatgggaaggggagaagacaaattaattcaagtactttggaaggacaaatgggtaatcagcttggcaggtgggccagtgggcagaagctgacagtgagatgatcatgaacgaagacagtagctccactatacagaagaaagcccatgagcatagcgtgcaaatggaccaggtacacatgtgtctggacaggctcccactgtccagtcacaaatgaataagcgagatagagccaagacagaggtccagtcctaggaggccccagggtcccctcccaccagccagggtcagatccagtggggtttatcagccagaggggtgtgtgtccatctgaagtacatggcagagaagtggtccttgtgggttaggaaatcagatttctgggnactgtaaaaattcccaaaattagtctgattttctgggaggaataaggatcattaatggtttcagaatttgaataaggtgactgcttctttgtaccgtcgttaggaaagatggaaaactaagttttaaaccacagcatgaggaatttaaagcagctatgaagactgttagccactgaggaaagtaatcatagggcactgccagttatagagcagaagggggtccccgcgtggctgcacagttggcagaaagggtcgtagccaagggaccttcaagatcccttccagcactgggatccgataatcctaacctcactggctctgctgggccagcttctgatacaagcagtacccgagtcttccctgtggtgaggatgtccgtggaaacccttgttctttactcatggtatatgctcatcagagtataatctctttgaaggcaggagtgggtgtggccccctaaccctgagtgctgcacagtgcctaagccagtgctggggttcccctgggcatgtagagttagaactgaacatcaaacatccttagatataactcataaaatgactgcccctgcttgctttcctttaaggcattgttaatggaaatgccagagctcagaaattgagccctgggcctggcttgtatctgaggtggctcagagccaagctgtcctcgcctggatgggaggctggcccccaccatttagggcagggcaggaggcggtctgtcgatgatgacagggaaggagtgtctggatggacatgcagactgcctgacctgacctacttggctacaggaaatagtacattccttcttggttcttttaaaaaaatatgattagaaacccaattttagttaatgaaagtggctgttaaagatagtgcctgagtagtatgttaaatctagcctgtaactgtcagattttggtgtctctcattttctcataacagataaggaaggaagcctggctgaccacctaaaatgcagttattttcctgtccccaaagttcacttcaacgaggggaatgggaagggcaatgtcttccataggaccctttccagtctcctcctgagagctgtgtcttccctggggcacactccagggctggctcctgccctcacagctgtgctgtgtggctctccctgcatgcatgcatgcccaagctggatttctccagaggccttgggccgggcagaatctagtgtgtccagctagaaagagccccacaaagataaggacatggatagatactgctggatgtccagatggtcgatagctgagccattccttcatggctttgtcagtttcctaaactgtctcagaagccagtcctcagccatagtggggggaaggggtgaatggtttttctcctcactgatgcttcaacttcaagagctccctttctcctcacagttcttccagctcccgggagaagggtatgtggatcaaagggagaaaacccatggtacgttatgcccgccttgaatggcttgcgagctggggttgccatcttgatcatttgggaggtaaggagactcatcacagcctcagactgccttcctaactccttcaaataatactgactctgacaaggaaacttaaatcatttaccatttaccattaagtcagtgttaccactgacacattagacacattagaaatgttttttctgaaaattttaaaacctctgaaaaaaggctgcaaatcttggctgaacacaaagcaaaagcatttagttgactcagattcacagcactgatttcttttttaaaacaattcaacaatgtgtgtgaacattgggcaaaatcagagagtaatggctatgatgactcctgagacttcagtatgtgaaatacatcattaacatcaatggtcaggctcctaagcctgggccatgcttcctgagtagcttagcaaccatgccttacagggctgtagcatgcacaatatcacctttctccaccccagcttgcttgcaatcttcaagcactggtttcagtgtcacagatagaaaaatgagattcataggacacagggtaccatatagtcaccattctaaagtaccccttttgaaacatttcctaaaatccaagtcaaaattaatgtctataatattttaaatgtgctttttgtaaaaactgtgtgttagtttcatgatttttgccttttttacactatatgccatgattttcacctgacagtaatagccaataaaaagccagaaagtaatgcttca

SEQ ID NO: 422122 - DNA, 2841 bp, Homo sapiens
gtcgcctactgtcacggtgttaacctccctctctgtctctctgagtgcgttctctcgcccgtcacccctcttcctttctcggtctcctcctctcccttcgtccgagccgctccttagcgcccagttgcgcaaatcaaattctttcccgttctatttactcctgatcaagaggggctgtcagtccaaccctccagctgtaggctcgtgcatctgccagtctcttggcgcgtggggaccgcgtggaagtgccctcgcgtgtgcgtgccagctgagatgagacgtggaagctggaggggtccggcatcccagagaggcgtgaggctcccaaaccaccacctgctcaggtccaccctaataacatcagccaaggcctctacagcagcccccaagctgcctctggatagttcagacaaggcctctgtgctgtgatggaaccaggtgacccgcagcctccgggccagctactctggcttggctgaggtcttcctagataatcaacatccctcaacagccttggcggtgagaaggcacgtgaaagctgccagcacatcccaggagccttggctgtggcggcttctccttggaaagctccacgcacccttctgccagggatcctgtcctgcagggatgacagacccagcagcctcggcagagggaatgaggctccagcagcttcatcagcaagtggccaggcccagccctaagtcacagactgtcagaaggggacaatggtaggagagagctgggctcagggtctggagcctgccacatgccacctgcacggctttggatacactccctccttcatctgtggaacggggaatggggataacaccctggcccaagggtcacacagaaccaaaaggaagctacagcctaaggaagaaaccctgctatgggactgtggctgctctggactgcgcaggctgccaggaaggaatggcggaggcagcctccgtgggccttgcacagagtgagagcaccacaattatgggccatgtgtgcgcagagagacacacccatgaccgatacgtaacaagcatgtgcccctacctgccgctgccgatggatggaaatgcaatggatttcagcttcttatcatcagccagggccaagcagtttttcactgtcttttccagaagttcttcacacttgtctgcaccccaaactggactattacagtggatcacaaacttggcaggcaggccatggcctgcgctgacagcagctagtggtgcggggatgaaacagaaacagtgagctctggttcactgcaaagcacaagatgccaaacacagacccactcccctgccacggtatatcttcctgggccctccaatgccctgtgtctgaggagttccacagctgtctgctgcgttgtgattccaacgtgagctggagccaagccacacccttggaaagttggcattatgatgtgtcaccaccaggaattttgaccaagttcgtagtaagcctctctccactctcagaaagcatacacggttctcccagaggcagagccttatccatcaaaactcaactgaacgcaaactcaacgtgtcagaacatttgcagcctcaaaataattgttttgggtttccaacccttcttcttcaagtcgactggtgtgctaattatcgacttgcacaccaatatgatatatttgtctctactatgatgtattctctaaatctcccaaacccaattcaggacaaagctactaggaaagcaactgctttaaatgatctgctaagcaacctgaccagcatctccactctgccattgtcttctccctgctgaggatggcctcactgtgtgaataacggatcctgtttatttgtggcagaattagattagtttttaaggaactgtgtttttcttttcctagaagaggggcccctttctagctatacatctccaccaaagacttgcctttcccttgccagatctaaggacacaggcctggggtctgccacaaactgcaaagtaccatgtctcccagagcatgttccagaacccctgtccacagatgctctgcaaagaaggtttccagggcactgggtttagctgcatgctacgcttctatacaagagcacaccagagtctccacaccactgctaaagtaaaacatccaaactttttgcatttggttggctatttctgaaactttttttttttttaaggaatatctgtccaaggggtatggtttgttatggtcgtgtcatagatactggagaaggagcgatttgtgggtagtgtctcatggtacagtggaaacagctcagtcacagggtgtgaatttgagtcctggctctgctttgtgactgggcttgagaactctgggctgacctataaaaacctgacattgggggttgaattaaaccagtgggtttgtccccatgagaagtcatggctaaactatgcatagaaaacgactggaaagaaacattaacagtgactatctttgcacagtggaacaggagtatgttttattcacctctttatactttcaaaaatattttaaagcagtttctaaaatagcccttaaaatcaagaacaaaagtgttattgaaacaagcaaaaatatcttgaaccatgctatacctaatgggtttgcatctgctgtggctgaggtttccccagcagagtttggtacatggcagcaccaggctgcctaccaggccttgtgccaagggctaccagcaggactcaagctggaaccccgatgggaaaggacccacaggctggtcaaacaggtgttttaaagggcctggggaaaggccagctgcccctggctaggtagttaaaactgtgtatgccttcccttgtacaatgtgggac

SEQ ID NO: 422123 - DNA, 6561 bp, Homo sapiens
  misc_feature (319)..(319): n is a, c, g, or t
  misc_feature (4327)..(4327): n is a, c, g, or t
acagataggatcttgctgttgcctaggctggagtgcagtggcacaatcatagctcactgcagcttcgaactcctgggctcaagcaatcctcctgcctcagcctcctgagtagctgagactacaggcacgtgtcaccaagcccagctaagttttttattttttgtagagatgaggtctcactatcttgcccaggttggtctccaactcctggcctcactcaatcctcctgcctcagcctcccaaaacgctggagttacaggtgtgagccactgcacctggcctttgtattttagtataaaatgtgctttggatagaatcnttgctttttctagcttgtggcctttttttttttaagtatctgtataaggcagttggaaaacaagttcaagctggacactcttgagtccagtcctcatgttttcagcccactgttgcacccagttcgtgtgggtcaggcctgggcccatggaatgagtgtatctcccagtaaggaagtctgctatctgacaaaaacagcagaagctgagagctcaagggatacaaaatagattgcagttgagggttaggaaggaggctgcatctgtgtgcctatttcccctggcaagcctctacatcgaagagcagcagagcagccctgtcgtgccattgagctgacagtgccacatatgcaaagataaagccatagaggcaggacacttgaggggcacctctcagtctgccctgaaccatctgccatcttgaacagggagacaccatggctctggggcagttttcctccataagaactcacttggagatattgcccttctgtttaataccatcctctagccaaataattcaagaaggtggcattcagtcatatactgttttcagttctaaagaaaagttgaagtgatggtagtaaattgtggactaaagacagcttaatagcatactgatgtggcctgtcttctctttcaagctttgtcatttctaattaaggtttaaatggagaaactatcattttgtagttacctgagatttttcagttctaaagtaaaaacaaaaaaacaaacaaaaaccaacacgtttaaaaatccctccccaagtaaccagcagtcagtttgatcattatggaagagaattcagatggcaatgtatttgcaattgaggagagagtagccaatcacacttaatgaaacagaccgtttacacttggaatggcctggagtaagttgatattcagcgtctacactcaaatatcaatcttggatttggaaatttggcttgaccactgtaaagtctgggaagatgaaatgcctaaattctgggttccataacttttcatctgacagctggtggtgccgaaccccgtccccaattacctaggtcatctttaaggtcaatgtcagcattggtaggattgattatggcctccacctcaaagccggctaaattactgatttcactgtgaataaggttcagctgcaaagaaaagcatgaggtgggaaataacaggagagctgggaagtctcagagaaggagccttgggatacaggtaaaggacagtggacactccaagtgcacgaggcacaaaagggaagcagggagttgctggctcaaatgaacccatttcaaacataagactcaaatgctgctcgggatgcgggagcaagcaaactaggatgaatgttcagagcccgtgggtggcacctgggacaaaaggaagcacaagccacagtggacgaggagatcagctttcctttaaagggacttgtgatctgggggccaaagtaaggcagctatcaggacctagaatgagtactcattgctgagggttgggggctggtggatgtgactgtcctcatccttgagcactaggctggtgctaacatcctacctggcttgggcaaacccctaagggctctgccattgtcttccaagtgactatgggcctttaaggctgtccccatcactgtgactgctggctggcttccctgccctgctcagggtggcaagaagtgagaatagtctcttgcttagtaacatttaatttacgtgcccattagtcatgtaatgctgaagttccatggtgaaacccaggggaggaaggttctccagcaagacaatgtgtcttttaaatggttttcaccttgttggtcaggttgctctgagactcaatgggtggcttattgagcattttccttaagtgttatatccacccagtgaatttgttctttctgaagagccactgaatgggtgtcccccagccactgttattctgttacaatggcaaccctggcatctgagtattcgaagaatactgagttcgaaattctgtcagaggggcaaggggaattaatgggcctaggactgctgtcccaggtcctactattccccttgcttttctttaggtattgcaggaaagcttgctcttgcacatgctctcacaatgacattgctcactcttcagtaacataaattcctaacacctgcagacaagtgcaatgcctgagtagccctagcagagctggtgctcaagactatgacctaggccagaatagtggctgcagtctgcagggtttaccagggcatgaggctttgtccaggagctcacccaggagagggctgtgcacaagacacttggcagggaagctcctggcaacagagcaagttgctgcatttctagggccaaacattttgttgaaaacaaaaccaaacaacctggcactccagaagtatcggaaatataaacccacatttttgattcccagaaacagtcagattctcaaagagggatgtgcttacactaagagtcatcctctgggaggaaacagttgtggaattaagttttgtcaaacagccaaggaagaattctgggttattgctcctcgcactatagagtgatttagaggccacccacacccttgaagctgaaggaagccatgggggtgatctcacaaagcgaagctctcagcagctcagagccctggcaccaggacagaggcacagaaaagagacagcatgggggctggggcctgactgctgccactggggagtaggggtgtgggtgggcacagagtcgggggccttagggtaaggcaagtgaactctcaggatttagaacaaggcaaaggattttactctattatttagttctgcatttggctccaagcaaatgctatttacaaaaactcaaattaagccaatactccccaccacacaccaccaaaacacaccccacacagtgtgaagaggcaggaggttggtgaggaaggcaggcaaaggagaaaaagactcgatctactcagtgtaatgtggatgtgtatgcttttaaggcacctataaattcctatgtttaaaacaatacatgttcaatccttaaaattcacgcaattttttccaattgtatagatgcttctggtgttatattcagaaatgtttcattggaaaagaagctattttggcgggctctgcttcagctagccaggaagaccccctcagtggcctgtatctgactctcttcgcgggagaaccacctgctctgtctaggggaatgggattctctgggggaaacttggatttgctgaaggaagggagcagttgcgaacagaactcaagctcatggagaattctcagcttcctttggactcactaccttcccttctgaccagaggcatccccactcttggaagtgcagactacagtacctcagggagccactactactcagcattgaggatttcctgccaaccaagtgctgtttcactcttcacatctgtggatgaggctagagctgtgattttccaactatgctctgctatgcactggggctcagcagaagtcctcagggtatgcagctgagccacaaaagtttttttgctgtaaaatgtgtacaaatatgtatttttaaacaatcttgactagaaagtgtgtgcttgggatgtgtgcatcaggggaagagaatgggaaggggagaagacaaattaattcaagtactttggaaggacaaatgggtaatcagcttggcaggtgggccagtgggcagaagctgacagtgagatgatcatgaacgaagacagtagctccactatacagaagaaagcccatgagcatagcgtgcaaatggaccaggtacacatgtgtctggacaggctcccactgtccagtcacaaatgaataagcgagatagagccaagacagaggtccagtcctaggaggccccagggtcccctcccaccagccagggtcagatccagtggggtttatcagccagaggggtgtgtgtccatctgaagtacatggcagagaagtggtccttgtgggttaggaaatcagatttctgggnactgtaaaaattcccaaaattagtctgattttctgggaggaataaggatcattaatggtttcagaatttgaataaggtgactgcttctttgtaccgtcgttaggaaagatggaaaactaagttttaaaccacagcatgaggaatttaaagcagctatgaagactgttagccactgaggaaagtaatcatagggcactgccagttatagagcagaagggggtccccgcgtggctgcacagttggcagaaagggtcgtagccaagggaccttcaagatcccttccagcactgggatccgataatcctaacctcactggctctgctgggccagcttctgatacaagcagtacccgagtcttccctgtggtgaggatgtccgtggaaacccttgttctttactcatggtatatgctcatcagagtataatctctttgaaggcaggagtgggtgtggccccctaaccctgagtgctgcacagtgcctaagccagtgctggggttcccctgggcatgtagagttagaactgaacatcaaacatccttagatataactcataaaatgactgcccctgcttgctttcctttaaggcattgttaatggaaatgccagagctcagaaattgagccctgggcctggcttgtatctgaggtggctcagagccaagctgtcctcgcctggatgggaggctggcccccaccatttagggcagggcaggaggcggtctgtcgatgatgacagggaaggagtgtctggatggacatgcagactgcctgacctgacctacttggctacaggaaatagtacattccttcttggttcttttaaaaaaatatgattagaaacccaattttagttaatgaaagtggctgttaaagatagtgcctgagtagtatgttaaatctagcctgtaactgtcagattttggtgtctctcattttctcataacagataaggaaggaagcctggctgaccacctaaaatgcagttattttcctgtccccaaagttcacttcaacgaggggaatgggaagggcaatgtcttccataggaccctttccagtctcctcctgagagctgtgtcttccctggggcacactccagggctggctcctgccctcacagctgtgctgtgtggctctccctgcatgcatgcatgcccaagctggatttctccagaggccttgggccgggcagaatctagtgtgtccagctagaaagagccccacaaagataaggacatggatagatactgctggatgtccagatggtcgatagctgagccattccttcatggctttgtcagtttcctaaactgtctcagaagccagtcctcagccatagtggggggaaggggtgaatggtttttctcctcactgatgcttcaacttcaagagctccctttctcctcacagttcttccagctcccgggagaagggtatgtggatcaaagggagaaaacccatggtacgttatgcccgccttgaatggcttgcgagctggggttgccatcttgatcatttgggaggtaaggagactcatcacagcctcagactgccttcctaactccttcaaataatactgactctgacaaggaaacttaaatcatttaccatttaccattaagtcagtgttaccactgacacattagacacattagaaatgttttttctgaaaattttaaaacctctgaaaaaaggctgcaaatcttggctgaacacaaagcaaaagcatttagttgactcagattcacagcactgatttcttttttaaaacaattcaacaatgtgtgtgaacattgggcaaaatcagagagtaatggctatgatgactcctgagacttcagtatgtgaaatacatcattaacatcaatggtcaggctcctaagcctgggccatgcttcctgagtagcttagcaaccatgccttacagggctgtagcatgcacaatatcacctttctccaccccagcttgcttgcaatcttcaagcactggtttcagtgtcacagatagaaaaatgagattcataggacacagggtaccatatagtcaccattctaaagtaccccttttgaaacatttcctaaaatccaagtcaaaattaatgtctataatattttaaatgtgctttttgtaaaaactgtgtgttagtttcatgatttttgccttttttacactatatgccatgattttcacctgacagtaatagccaataaaaagccagaaagtaatgcttca

SEQ ID NO: 422124 - DNA, 402 bp, Homo sapiens
cgacgtgggcctgcgagagggtccctgcaattatagttgtcccaattagaaggggacaatcactcaagaagccctctagctacttaaagcaatcttgcacagccatcacttatacctaacaatcctttgtcatacttaataaacctctggtatattttcctttattatgcttgttaaaaacacagtataaatgggagaaatcattaaagatcattaactccaaggctgctggatgttaggacccttaagcatacttaaaagattgattgtaatcaagaataacttgtatcagattgccttccagtgattcacatttattagttcaaccagttacatacctgtagcaagagaccagtttatttggcaataaaattggggaaggaatcaagacttaaatgagga

SEQ ID NO: 422125 - DNA, 1869 bp, Homo sapiens
gaaaggggaaaaatgactcagaacaagacaaaagctctgactgtttaaagttatcgcttacagagactttaacaattttgtggaatttttacaactatgagagtaaatggaactggtcaactcttgacagttgcctcaagatggagtgaaattgcatcgagggtaagactgtgtccacaggtttaaaattctctcttctgagtaatagtgttcatgtgctcccattctcgaccctgttgttgaaattcaaacttaaatagcctgacttcttgttgggtaacttgccctgcctccagaggtatttgaacttcattatcttcagcacaggaattgttaatcttctcacttcacctgttcttgcattagctcaattgatgtcatcactgatttcctaaactagaaactatggaagcatctttgacttttccttttctctgttggattagcttaatcaccaagtcctgtcaacttctgaaatgaatctcaaatttcttcccttctctatctgttgcccctgattttgccttaagttcttgcctgagtgatctcccagcctgtcttctgtctccttttggttcagtctttatactgcctcttgagtaatctttctgaaatttaaacttgatatttttcgccctcttgcttgaaaacttcacttgcttccccatttcctactctttaaggaatgatttctttagcctcagatagaaggacctttatgatctggccatattctgaaatagcttcaatcctctcctcatctctgttccagtatacatctttccttcttattctgcaaacattagaccacttgatattctttaaatatgtcatgtacttttcttgtgtctgttctttgggataattcctatccttttcagggaggcaaattgcacgtgagtttaagtatgaaggcaatgtatacctgctgattgtaaaatatttaaacattgtacatatctgtgtggttttaaaagtctgcttttaattatgtaaaattcatcttccctttccacagataacttctgttaacaacttgatatctattgtacaagatgtgttactggcatttccatgtatatatgtatataaatgcaggaaaccaacatgtcattgacacctctcttctttacttttccccatatctaatcattcctcaagtcttactgatttttatcagctagaatctatctccttatttctacctctattgccactctgatccaggctaccagcatttccctcttaggcttctgaagcaacttcctaactcccacttgtgctcctcacactcactctggtcggctatccattcattctccatacagcaactagagtcattcttttaaaattgcggacctgatccttccatctcccagctgaacgcttttcatttgcttcctgttctcatgagtatgccaaaatgtattctgggctaggaggccctgaggaatttggtccttccctcctcccccctcgttttctgtgcttcgccctcactgggcttgcctttcttttccttaaatacatcatgttctctcctattttagatccttttccccgaaggtatggaaacattatttctgtaagcttattcttctatatagatgggaagtttttaaatcagataaggttctaagggcatgtggacaatttacgttatcatagtattgttcataacgtccatcattattctgtagactgtaagggcttacttagctcgtgtaagaattatccttcaaaaagcatttttaaggtattagtattgctaatctataaactttgtgcaagaagtcctaaagtcaatagcaacatttatttaaagtacagtttgtcatacttaataaacctctggtatattttccttta

SEQ ID NO: 422126 - DNA, 2107 bp, Homo sapiens
gaaaggggaaaaatgactcagaacaagacaaaagctctgactgtttaaagttatcgcttacagagactttaacaattttgtggaatttttacaactatgagagtaaatggaactggtcaactcttgacagttgcctcaagatggagtgaaattgcatcgagggtaagactgtgtccacaggtttaaaattctctcttctgagtaatagtgttcatgtgctcccattctcgaccctgttgttgaaattcaaacttaaatagcctgacttcttgttgggtaacttgccctgcctccagaggtatttgaacttcattatcttcagcacaggaattgttaatcttctcacttcacctgttcttgcattagctcaattgatgtcatcactgatttcctaaactagaaactatggaagcatctttgacttttccttttctctgttggattagcttaatcaccaagtcctgtcaacttctgaaatgaatctcaaatttcttcccttctctatctgttgcccctgattttgccttaagttcttgcctgagtgatctcccagcctgtcttctgtctccttttggttcagtctttatactgcctcttgagtaatctttctgaaatttaaacttgatatttttcgccctcttgcttgaaaacttcacttgcttccccatttcctactctttaaggaatgatttctttagcctcagatagaaggacctttatgatctggccatattctgaaatagcttcaatcctctcctcatctctgttccagtatacatctttccttcttattctgcaaacattagaccacttgatattctttaaatatgtcatgtacttttcttgtgtctgttctttgggataattcctatccttttcagggaggcaaattgcacgtgagtttaagtatgaaggcaatgtatacctgctgattgtaaaatatttaaacattgtacatatctgtgtggttttaaaagtctgcttttaattatgtaaaattcatcttccctttccacagataacttctgttaacaacttgatatctattgtacaagatgtgttactggcatttccatgtatatatgtatataaatgcaggaaaccaacatgtcattgacacctctcttctttacttttccccatatctaatcattcctcaagtcttactgatttttatcagctagaatctatctccttatttctacctctattgccactctgatccaggctaccagcatttccctcttaggcttctgaagcaacttcctaactcccacttgtgctcctcacactcactctggtcggctatccattcattctccatacagcaactagagtcattcttttaaaattgcggacctgatccttccatctcccagctgaacgcttttcatttgcttcctgttctcatgagtatgccaaaatgtattctgggctaggaggccctgaggaatttggtccttccctcctcccccctcgttttctgtgcttcgccctcactgggcttgcctttcttttccttaaatacatcatgttctctcctattttagatccttttccccgaaggtatggaaacattatttctgtaagcttattcttctatatagatgggaagtttttaaatcagataaggttctaagggcatgtggacaatttacgttatcatagtattgttcataacgtccatcattattctgtagactgtaagggcttacttagctcgtgtaagaattatccttcaaaaagcatttttaaggtattagtattgctaatctataaactttgtgcaagaagtcctaaagtcaatagcaacatttatttaaagtacagtttgtcatacttaataaacctctggtatattttcctttattatgcttgttaaaaacacagtataaatgggagaaatcattaaagatcattaactccaaggctgctggatgttaggacccttaagcatacttaaaagattgattgtaatcaagaataacttgtatcagattgccttccagtgattcacatttattagttcaaccagttacatacctgtagcaagagaccagtttatttggcaataaaattggggaaggaatcaagacttaaatgagga

SEQ ID NO: 422127 - DNA, 1023 bp, Homo sapiens
tacgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaactta

SEQ ID NO: 422128 - DNA, 394 bp, Homo sapiens
actcttgaggatccccctcgggttggaactgaatgggatgatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaactta

SEQ ID NO: 422129 - DNA, 1533 bp, Homo sapiens
tacgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttcttttattttgcctgaaatcctactcgttgacatttgagattttaagctttgtggctgaaaatatatagatctctgaga

SEQ ID NO: 422130 - DNA, 1102 bp, Homo sapiens
agctctcaagtgggagccgtgggatgggagggatgtgggattgaagcgttggccgcttttatcctagccagttgaaaaacgtctgacttccgaagtatgagacagatggtatagtggggttaggagcacagccctcggaatccgacagatctgagtgacagtctggcgcgtccacttaaagctttgtgactttggaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaactta

SEQ ID NO: 422131 - DNA, 1145 bp, Homo sapiens
tacgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactgtagagatacggtcttaccttgttggccaggctggtctcaaactcctgatctcaagtaatcaactcgcctcggcgtcccaagtgctgggattacaggtgtgagccaccgtgcctggcctgaaggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaactta

SEQ ID NO: 422132 - DNA, 1063 bp, Homo sapiens
tacgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgaatgtgttttgttttgaaagctataaattttgttttacagtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaactta

SEQ ID NO: 422133 - DNA, 623 bp, Homo sapiens
gttctagaggtccctgatgtcgttcttatggcttatggtccttcttgataggtagtgagaatttggtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaactta

SEQ ID NO: 422134 - DNA, 1722 bp, Homo sapiens
gattgaaatgtgtagaggggagtagataggtggtagaagtagaggtaagagtgcaggtagcggtagcgatggacactctgtatcgagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattagatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttcttttattttgcctgaaatcctactcgttgacatttgagattttaagctttgtggctgaaaatatatagatctctgagagggatgtctgctatctgattattgataaattacactactgttgattgttttaagagactctactactaagtagagcccaccccgcttctctgagacgaaacctgtgttttttggttggtttgtttttaagagatggggtcttgttctgtcacctagggtggagtgcagtggcacaatcacagctcactgcagccctgaactcctgggctcaagtaatcctcctgcctgagcctcttacgtagctgggattacaggcatgagccactgagccctactttttttttttaaagcaatgaggtcttgctgtgttgcccaggctggactcaaattcctgggctcaagtgatcctccc

SEQ ID NO: 422135 - DNA, 1256 bp, Homo sapiens
actcttgaggatccccctcgggttggaactgaatgggatgatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttcttttattttgcctgaaatcctactcgttgacatttgagattttaagctttgtggctgaaaatatatagatctctgagagggatgtctgctatctgattattgataaattacactactgttgattgttttaagagactctactactaagtagagcccaccccgcttctctgagacgaaacctgtgttttttggttggtttgtttttaagagatggggtcttgttctgtcacctagggtggagtgcagtggcacaatcacagctcactgcagccctgaactcctgggctcaagtaatcctcctgcctgagcctcttacgtagctgggattacaggcatgagccactgagccctactttttttttttaaagcaatgaggtcttgctgtgttgcccaggctggactcaaattcctgggctcaagtgatcctccc

SEQ ID NO: 422136 - DNA, 393 bp, Homo sapiens
ttttagtagagacagggtttcaccacgttggccaggttggtctcggactcctcacctcaagtgatctacccacctcagcctcccaaagtgctgggattacaggtgtgagccaccacgcccggccaaatattgtttcacataacttttatttgtctttgtatgatgtgtatactgggtgacaacttcaaatttttttttttttattactatgcattgtggtcaggatggtttgaaaaccaaaagttgttgttgatgatgctgtgctttttgttcccttctgtacacctaaatagaccctatagtcctagggtcagactggcgtggttgaagcatggaagacttgttagatctggaacgtcctttcagcttctgtatcagacagacagatgttag

SEQ ID NO: 422137 - DNA, 1885 bp, Homo sapiens
tacgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttcttttattttgcctgaaatcctactcgttgacatttgagattttaagctttgtggctgaaaatatatagatctctgagagggatgtctgctatctgattattgataaattacactactgttgattgttttaagagactctactactaagtagagcccaccccgcttctctgagacgaaacctgtgttttttggttggtttgtttttaagagatggggtcttgttctgtcacctagggtggagtgcagtggcacaatcacagctcactgcagccctgaactcctgggctcaagtaatcctcctgcctgagcctcttacgtagctgggattacaggcatgagccactgagccctactttttttttttaaagcaatgaggtcttgctgtgttgcccaggctggactcaaattcctgggctcaagtgatcctccc

SEQ ID NO: 422138 - DNA, 1305 bp, Homo sapiens
tcttgtttcctgccacttcggctctacacagtgtgcattctggaatgacagggtcttatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttcttttattttgcctgaaatcctactcgttgacatttgagattttaagctttgtggctgaaaatatatagatctctgagagggatgtctgctatctgattattgataaattacactactgttgattgttttaagagactctactactaagtagagcccaccccgcttctctgagacgaaacctgtgttttttggttggtttgtttttaagagatggggtcttgttctgtcacctagggtggagtgcagtggcacaatcacagctcactgcagccctgaactcctgggctcaagtaatcctcctgcctgagcctcttacgtagctgggattacaggcatgagccactgagccctactttttttttttaaagcaatgaggtcttgctgtgttgcccaggctggactcaaattcctgggctcaagtgatcctccc

SEQ ID NO: 422139 - DNA, 1733 bp, Homo sapiens
gcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattat

SEQ ID NO: 422140 - DNA, 412 bp, Homo sapiens
tcatatatgtacattttttacctaaaaatatctgattaaaggtattatttaataataattaaaatccgtgggcacagttttgaagccttctttagcttttcagtttaggctgggcccagtgcctcacaccaataacttcagcactttgggaggctgaggtgagcagattgcttgagcccaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattat

SEQ ID NO: 422141 - DNA, 607 bp, Homo sapiens
tcatatatgtacattttttacctaaaaatatctgattaaaggtattatttaataataattaaaatccgtgggcacagttttgaagccttctttagcttttcagtttaggctgggcccagtgcctcacaccaataacttcagcactttgggaggctgaggtgagcagattgcttgagcccaggagtctgagaccagcctgaccaatgtgatgaaaccccatctttaccataaatatacaaaaattagccaggcgtggtggtgaactcttgtagctacttgggaagcttaggtggaagggtacttgagtctgggaggcggaggttgcagtgagccaagatcatgccactgcactccagcctgggtgacagtgtgagaccctgtctcaaaaaaaaaggttttcagtttgtgctgccacccttacttccttccttcagttacagctgaactgaggcatagacatagatacatacctgtctcaaccagagctgattacattttcaagataaacgtgtgaagtccaaattctaggtccagaaatagaacaacaaaaaaaagatattaaatacagtttactatagtttctaataattttccatttcaaatgaag

SEQ ID NO: 422142 - DNA, 638 bp, Homo sapiens
ctttcatcccaagtaaatctagattaaaaaactatgctatcttgtatttccattcaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaaggtatggaaagcatattgctaaatgcctcctgtgtgtcaggcactctgccaggtgtgtcatcatgcaattcccagtctagtggtaggagaggcaagtaaaccatcacagtattcagtaactgtgaaccacagggttctctgcagcacactacataatctgggttgagaagggagaaatattggttcatagaagacttcctatagtatgtgagaagtggctgaattttaaaggataagtagacgttaactaaatgggagaggaaaagatggaaaggcaagccaggcaagatgtttaaatgtttagaggaataaatgagcatcatgcatttaaggaactttaattaatacagtataaccaaagcccaaaggtttcagtgagagataagtttagaaaagctttgaccagaatgcagtgagaagcagttatgatttgcag

SEQ ID NO: 422143 - DNA, 1714 bp, Homo sapiens
gcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaaggttatttttaaaaaactattctaagacacgatttggttataggattaaatggagaattatttgtgggaacaatagtactgtaattttttttcactttttagtgttttgatgtgtttttctacagttctctgttgaaataactgaatttggctaacattttatttgctttaaactgttaatacttgctttaaacaatgaacagacattttatatcactgtagatacaaaatattaaagcagtggtttcagccaattaaatcaatctgtgagagtggagcccaggcctgccatttttgttaaaagctccccaggtagttctaatatgagccaaagttgagaagcaaaagtattgtaaattatttctctcaaatttagagttattacagtttatatcaaattcaaaatgcttaatttgcttttgtgataaagagcaatagaaggtggtgagatttctaaaaattaggcctccaggtatgcatttcaaatgtagacttcttaaatgatcgggatcagattgtgctgcctaggtagtctgtttttttttttaatgtcatttacataatcattttccatttcctaagcacaaatgaagttaacatctgagttagcttttgaaagacacctttttgtggggtagggactactgttacaaa

SEQ ID NO: 422144 - DNA, 1679 bp, Homo sapiens
gcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcagatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattat

SEQ ID NO: 422145 - DNA, 1425 bp, Homo sapiens
ttttatccgttttaggttttaaaccatgtgaatatatacccttctcaagaaatgatttttttggagtagaatttgttaacatttttaagtgatttttttaaattatatgattctgaatgatgaaaacaataaaccacttctgtttccctttccctcaacttttaaattgtaatataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattat

SEQ ID NO: 422146 - DNA, 2182 bp, Homo sapiens
gcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattataatacaagtattgaatgaaccattgaaacactagaagtcaggatgtttccgaatgccagggtttcaaaatcaagacaattctatgaagtaaaaagtagattagctattagaacaaagctgaaattagaaccttatatgctttaaataacttttaagaatttgcttgacctgtggcaatccaaaaatacatcagtatttataaattctagacttctgttactacttctggcatatccacacttttttctgtcagtggattacataattggaaatttcagtacatctagactgtctctattttctttttctttttttatttttagtagagacagggtctcactgtgttgcccaggcaggtattgaactcctgggctcaagtgattcacccacctcggcctcccaaagtactaggattatgggtgtgacccactgtgcctggccattttctt

SEQ ID NO: 422147 - DNA, 1992 bp, Homo sapiens
gcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtaaagtgattttggtttcattcgctctcctcggtagctttatgtgagtgctagcgccatatgaccagcctacggaaataaaggcacgacaaggcttccgtcagatctgtctctcgttagagctggcgtgaagaaccctcggtcagttaccaaagattctcacgacgcctttggtcaagtattagaacatcaactccacgagaataggccttggttttagtcattggatcttctgtgtttacagtactacttggcacaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattat

SEQ ID NO: 422148 - DNA, 2643 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggtgcttctacttgtccacaacctgccccagaatctttttggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgagattcagaacacaacctacctgtggtgggtaaataatcagagcctcccggtcagtcccaggctgcagctgtccaatggcaacaggaccctcactctactcagtgtcacaaggaatgatgcaggaacctatgaatgtgaaatccagaacccagtgagtgccagccgcagtgacccagtcatcctgaatgtcctctatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaaaaaaaaaa

SEQ ID NO: 422149 - DNA, 530 bp, Homo sapiens
accacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaatacacacaagagctctttatctccaacatcactgagaagaacagcggactctatacctgccaggccaataactcagccagtggccacagcaggactacagtcaagacaatcacagtctctg

SEQ ID NO: 422150 - DNA, 267 bp, Homo sapiens
  misc_feature (206)..(206): n is a, c, g, or t
accacccaaacccttcatcaccagcaacaactccaaccccgtggaggatgaggatgctgtagccttaacctgtgaacctgagattcagaacacaacctcagctcgtggaggcatctacacccacccacagcagcactggctcgctacacacaacactgacccctgccagctccacaagcgctggccttcaggaagaatctaccacnttccagagctgccaagctcaagtgacacaacacctcacctcccgcaccacacagccccttg

SEQ ID NO: 422151 - DNA, 354 bp, Homo sapiens
acagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccacccaccactgccaagctcactattgaatccacgccgttcaatgtcgcagaggggaaggaggtgcttctacttgtccacaacctgccccagaatctttttggttacagctggttagaagtgaggctgtgagcaggacctccttccaggggacatgcaatctgcagggaggggctgaggggggtcccatgg

SEQ ID NO: 422152 - DNA, 1535 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggtgcttctacttgtccacaacctgccccagaatctttttggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgagattcagaacacaacctacctgtggtgggtaaataatcagagcctcccggtcagtcccaggctgcagctgtccaatggcaacaggaccctcactctactcagtgtcacaaggaatgatgcaggaacctatgaatgtgaaatccagaacccagtgagtgccagccgcagtgacccagtcatcctgaatgtcctctatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacacacactggg

SEQ ID NO: 422153 - DNA, 428 bp, Homo sapiens
taatacggaccgcatggcagcacactcccatttatgaataacagcatctgggtcagacattatccaataatagtaatattactcaacacagttttaatatcacctttgtaaaaaatattaccatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaaaaaaaaaa

SEQ ID NO: 422154 - DNA, 456 bp, Homo sapiens
ggggaggggctgtctcctgtgctacttctgctcaaacacccattcccatcatcactcatctccaggatgtccttaaggctcagggttcacattttctgatgggagaaacaggtgaatgtctcagactttggctcaggggacatagcgggggtttggttgagacttcagggttgtgacatggctcagggggacaccgtggcccttccacagaccaggaacttatgcttccctctgacaacatcacctgtggctttattctctttcctccagatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcct

SEQ ID NO: 422155 - DNA, 625 bp, Homo sapiens
  misc_feature (624)..(624): n is a, c, g, or t
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggtgcttctacttgtccacaacctgccccagaatctttttggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagtcctccttctcgcagtctctaatcactagtgaattnc

SEQ ID NO: 422156 - DNA, 445 bp, Homo sapiens
  misc_feature (44)..(45): n is a, c, g, or t
  misc_feature (51)..(51): n is a, c, g, or t
  misc_feature (56)..(56): n is a, c, g, or t
  misc_feature (62)..(62): n is a, c, g, or t
tcctatgttttgagtcagaactcaggagtgcaaacagcagtganncagcancctgnatgtcntctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgccaacatcgtgaaaccccatctctactaaaaatacaaaaatgagctgggcttggtggcgcgcacctgtagtcccagttactcgggaggctgaggcaggagaatcgcttgaacccgggaggtggag

SEQ ID NO: 422157 - DNA, 2261 bp, Homo sapiens
  misc_feature (179)..(179): n is a, c, g, or t
ctggattatagtgaggagtttactcaattaagtcaagagttttaaagtcttctctgatcagaatttgctatctgatcagagcaggccacccaatcacagcaggtgcttggaggggagtggaatctcagtagagttgatgactcaccaagtgtaaatgggaaaaagcaacacagtcacanttccatgtatacccggagctgcccaagccctccatctccagcaacaactccaaccccgtggaggacaaggatgctgtggccttcacctgtgaacctgagattcagaacacaacctacctgtggtgggtaaataatcagagcctcccggtcagtcccaggctgcagctgtccaatggcaacaggaccctcactctactcagtgtcacaaggaatgatgcaggaacctatgaatgtgaaatccagaacccagtgagtgccagccgcagtgacccagtcatcctgaatgtcctctatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaaaaaaaaaa

SEQ ID NO: 422158 - DNA, 3269 bp, Homo sapiens
caggtgattatcctaattaatgtctatctaattaaattactgtcagcagctaaccaatggcaggagccgtttcatcggctgcacaagcagcaagatcaaaagtgagccttttctgattgctgcatagtgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccaggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatattttggtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctacccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaaggataggtgtctgttcataggcaagtcgattaagtggcatgatgcctgcaaagcaaagtcaactggagttgtatgttccccccaccttctaaatagaatagctcg

SEQ ID NO: 422159 - DNA, 3288 bp, Homo sapiens
caggtgattatcctaattaatgtctatctaattaaattactgtcagcagctaaccaatggcaggagccgtttcatcggctgcacaagcagcaagatcaaaagtgagccttttctgattgctgcatagtgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccaggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatattttggtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctacccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaaggataggtgtctgttcataggcaagtcgattaagtggcatgatgcctgcaaagcaaagtcaactggagttgtatgttccccccaccttctaaatagaatagctcg

SEQ ID NO: 422160 - DNA, 276 bp, Homo sapiens
ggaaccctcctcctgtggggtaacagtctggccgggggcccagtcgtggggcggtgtctgcagtccgggtccagatccgcggcacgcagagcccgggaggcccgagaggaaccagcgggcagaggacttgggaaaggcgcaccgacttccctgcaggcctgactccggtctccatggcgaaagcaggcaggtggcacagccgcggctctccatgagggagcagcttagattatatgctgttggattaaaatgtaataaacataggagtaaaaaaaa

SEQ ID NO: 422161 - DNA, 864 bp, Homo sapiens
  misc_feature (11)..(11): n is a, c, g, or t
  misc_feature (22)..(22): n is a, c, g, or t
  misc_feature (24)..(24): n is a, c, g, or t
ctcgtgcgatntcggcagaggntnaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggggggggggggaaaagatagggggggggcacaacgaaagtgagtgagcgccacacaaagtatttagaataacgagcgggccgccacaccaaagggggcgcttactaaatgatgacaagcgacagcggcgagtaatacacacaggcgagggagcgacaaaacagcggatcgcgacaatatagaggagcgccacacacacgggggggggcagcaggaggcgccacacccacgaagaagattacgcgccggggacacaaacaacgaagagggggataggtgacacccacgacgatatggcgcgcaggaatcggagcggacaaagaaaa

SEQ ID NO: 422162 - DNA, 335 bp, Homo sapiens
gggggggagggggggggaaaaattgtaaaaaataggagggagtttccggtgaggagcaccaatttcctgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422163 - DNA, 838 bp, Homo sapiens
agcgattctcctgcctcagcctcccgagtagctgggattacaggcgtgcaccaccatgcctggctaattttgtagttttagtagagacggagtttctccgtgttggtcaggctggtcttgaactcctgacctcaggtgatccgcccgcctcggcctcccaaagtgctgggattacaggtttcagcaactatgcccggcccagttatcagctattttttatattacatttgattactttaaaattatatcactctttttttttacattcactttagggaaggcttgcatattttgaactatttttttctttggcatttaatcatccttagcatttctcaggcagtcttgggttaatatggaaataacctttgtatacgttcttaatcttatttttaaaaatttttgcattttatgttgacaaatatattattgtgccacactttctatattaaaactagattaaatatattttacatatatttatttaaaatttttccagcacctatcaaaatacttttttgtgttccaattaaggtagtcttaatgcaaacttacaacttttgaactggaatattaaatttatacacttagatcttagaatttatggttaagttcttttttgttttttatttttaggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422164 - DNA, 590 bp, Homo sapiens
cggacgcgtgggttttaaggtgtgcacttttattcaactggtctcaagtcagtgtacaggtaagccctggctgcctccacccactcccaggagaccaaaagccttcatacatctcaagttgggggacaaaaaagggggaagggggggcacgaaggctcatcattcaaaataaaacaaaataaaaaagtattaaggcgaagattaaaaaaattttgcattacataatttacacgaaagcaatgctatcacctcccctgtgtggacttgggagaggactgggccattctccttagagagaagtggggtggcttttaggatggcaagggacttcctgtaacaacgcatctcatatttggaatgactattaaaaaaacaacaatgtgcaatcaaagtcctcggccacattgtgaactttgggggatgctcgctccaaccgactgctgtcaccttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422165 - DNA, 941 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaaacatgaatgcatagataaaacatgt

SEQ ID NO: 422166 - DNA, 1050 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaaaaaaaaaaaaaaaaaaaaaaattaatattaaaaagtagatttgtgtttctttgcggatgaacttgcgcattgggttatacattcctttgtcttcgtttctctttctttctatttctatagtatgcccccatttt

SEQ ID NO: 422167 - DNA, 429 bp, Homo sapiens
  misc_feature (11)..(11): n is a, c, g, or t
  misc_feature (22)..(22): n is a, c, g, or t
  misc_feature (24)..(24): n is a, c, g, or t
ctcgtgcgatntcggcagaggntnaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422168 - DNA, 1126 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaaaaaaaaaaaaaaaaaaaaaaaaaaaaaaaaaaaaaaaaaaaaaaaaaaaaaaaaaaaaaaaaaaaaagaggggggggcgcgcgcgccaaaaaatatacccccgggggggcgcccaatcgcgccccccccccttttttgtggaaaaagggggcgcccccaaaggggggggtaaaaaaagggggggggcggggcgggaaacggggggcgggg

SEQ ID NO: 422169 - DNA, 1202 bp, Homo sapiens
  misc_feature (926)..(926): n is a, c, g, or t
  misc_feature (931)..(931): n is a, c, g, or t
  misc_feature (936)..(936): n is a, c, g, or t
  misc_feature (938)..(939): n is a, c, g, or t
  misc_feature (944)..(944): n is a, c, g, or t
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaaataaaaaaanaaaanaaaanannaaaanaaaaaaaaaaaaaaaaaaaaaaaaaaaaaaaaaaaaaaaaaaaaaaaaaaaagaggggggggcccccttggcccaattgttttttaacttgggcaagttttttctttcggcccgaatttggcgttaattggccaatttccccttaaggggggggttttaaaaataaatggccggggttttacaaggcgggatggaaaaaccctggggtacccaaattaaacgccttgaagaaatcccctttcccaggtggggtaaaag

SEQ ID NO: 422170 - DNA, 1054 bp, Homo sapiens
  misc_feature (926)..(926): n is a, c, g, or t
  misc_feature (931)..(931): n is a, c, g, or t
  misc_feature (936)..(936): n is a, c, g, or t
  misc_feature (938)..(939): n is a, c, g, or t
  misc_feature (944)..(944): n is a, c, g, or t
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaaataaaaaaanaaaanaaaanannaaaanaaaaaaatgtaaattatatattagatttattatattgaatttaaaacaatcaatgggccgccgttttaacaagtcgggactggaccctggcgttaccctttttgggctcg

SEQ ID NO: 422171 - DNA, 1639 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgcgaaaaaaaaaaacaacaaaaaaccaccaaaaacaaatttgggggcgccggcccaccagaaaagcgtccttatcgacccaccatctatctttggagcaagctcgggtgacccccagtcctgcgttcaactgcaaccagtcggccaccaaggcgcggttccccacgggacacctccgcggcagagtaacatgcggtggagggggattcactacacataataaaaacacgtgccggggggagaacacgcagacgcgtggttctggcaaccaaccccaccaagtagtgggcctcagcgcagagcacaccagggaggcgtccatcaaccagggagagtttgccaacgcgagcagcgcggcaaaacaaaacaataagcacaccgcgcacgaggaggacaaacaaagcgcacatgaccagaaacgaaacaagacgatagccaacaagacacgaagggagacaagcaccgacaacagcaagagcacagtaagagcaagaacagagacacaccccgcggcacttcgcagtcgcaccacagacaacgacgagccaacaactacaaaatgaaaaaacgagcagagcctcaaaatcactcgacatcccgaacaacacgacccagcaacacacagaacacgcaccaagaccgacagcaccgcagccgcagaccagaaactcacaccgctcaccacaagccccgcagaaacgcaaaatcaccacagacagaaccggcaacgatga

SEQ ID NO: 422172 - DNA, 1168 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaatcaatcctccttctatccttttcctcactctcttcatttctccaaaaatctttcaacaaaaaaccacataaaataaaacctgttgccccttggcccattccttttaaattggccaagcttatcatcgcgcccaatttggcttcctgggccaattcccccattggggggtcggttacaaatcacctgcccggcgttttaaaaacgtttaaactgggacctctggcttccccaattccccttgtgggaccccct

SEQ ID NO: 422173 - DNA, 1027 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatggctttgtctgattttatcactttatgccaataatttcaacttttggtcagccttgtaaatcttaggtaaggatcaaagaaatgattcttttgccactaaacttgtgaaagcaacattatt

SEQ ID NO: 422174 - DNA, 817 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422175 - DNA, 962 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccagaggtactgaagtattttataggagatgttacttgtaattattagattaccaaaaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422176 - DNA, 866 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccagtgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422177 - DNA, 1384 bp, Homo sapiens
gcatgagccactgcgcctggccttgatgtcttaataaaaaaataacaccagtaagatttgatgattatgttgtgatagagttggctttctgagtcccattgatggcagtgaaggctatatttcagtcaaaaacatccattatatcccacctcttacagcaagggctttaaaacattttgactgtgatgcaaaataaaagcacactttacatctaaactttgtacagacatatttatgaccaaaactttgagtgattattttatgcctatcatattcataggaatgccacatacttggatttctgtgagtcttgcatgaagtctataatatgtcctcattttaaagatgaagaaatcatattaattacctgtttgggaaactctactctcacaccacaacaatcaacatggaagatctctgttgccaaatgtgtgggggtttttccctgcacaccaagtaatggacaccagctaggtgtcctccagttcagtttccacactatctactgggagatagcatcagattccacaggttgatggcacaagactgtcccctccttcccaccagttgcaagtttgggtcttcggaacttctgactgactggctttaagttggggttcccacaatctcctcgttggggaaacacatttaccagtttattataaaaggtataggctgggcatggtggctcatgcctgtaatcccagcatgctgggattacaggtttcagcaactatgcccggcccagttatcagctattttttatattacatttgattactttaaaattatatcactctttttttttacattcactttagggaaggcttgcatattttgaactatttttttctttggcatttaatcatccttagcatttctcaggcagtcttgggttaatatggaaataacctttgtatacgttcttaatcttatttttaaaaatttttgcattttatgttgacaaatatattattgtgccacactttctatattaaaactagattaaatatattttacatatatttatttaaaatttttccagcacctatcaaaatacttttttgtgttccaattaaggtagtcttaatgcaaacttacaacttttgaactggaatattaaatttatacacttagatcttagaatttatggttaagttcttttttgttttttatttttaggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422178 - DNA, 822 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422179 - DNA, 1278 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccagaggtactgaagtattttataggagatgttacttgtaattattagattaccaaaaggtaagagttgggataaacaagtatgtgtataaattagatcatatgacaatataaacattacaaaaaaagtcaaggacatgtaccatagtgctaatagtggttgtctcttggggaaagacctggtggagcagagcaatttacctttataagtagtttgattatgagtgatttttgttttattatggtttctagcttttcctaaataaagcttaaagtgattaaaaatagttgtatcatatatacctaaaatacaatactttattgaacagatgtactaaatagctactgtatgctggattagatgctagggatataatttagggttataaaccaaaatcccttccccacttttttaagggaaaaaaagtttcctatgactaaatctaatgtgtggcaattattggttcttttatatttaagttatattaaagttgttgagatcagtgtgtatgttttatagctttaatgtttatatattctttggaaagaccgtcattaatggatctcaaattaacggtgaaagaagaatgctgacttttaggaattcttattttaaaagtagtagtagtagagacggaataaagaaaattgtaggtcttttaa

SEQ ID NO: 422180 - DNA, 903 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtgcatcaggatatgcgatatattaacagcttgtggcatcctttatctattagcaagaggtccttcagtgattgcagcaatatcttggttcaggttcccttagctatgtatagcccagtaatgtgatagaatggctaggttttctatggggatcaagatttcttccgttgtagtttctatcaacaatgaatcagtttttcc

SEQ ID NO: 422181 - DNA, 973 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggtaaggcctttggaatgtttgaaggtttatagaaaagtaatagtaatgataactgataactttattgcttttgctatgccagtattttaatgcaggcagtttgtctccagaatttgatatcttactatatctcataatgattcaagagggtgactgatacatactgtataagagcattgtgatgtcttcttttttttttgaaatggagttttgctcctgttgcccaggctggattgcaatggcgcgatctcggctcactgcaacctct

SEQ ID NO: 422182 - DNA, 557 bp, Homo sapiens
gaacgagatcacgggactgagacggcgagccggctagagcggatagagccgtactgccgctctagtttttcttttgctctctatggttaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggtgaggagcttctcatcttgcattcatgatgggggcgagggagtggagaggaggctgaggcaccacgacagaaaaccctcacctgggaggggtgccgaaggcggctaatgaagtcaccttgattcgtgtcctttttccctgaccttactttcccttccgtctattcctctcgccccaggccgttactgggtagatgtaaggagtggagaggctggggaagtgaccagagactcgtgggttagacccgtcttgggttcttagtcaccacctctaaccctgtcggtcattgatgaggttagtagctccgatc

SEQ ID NO: 422183 - DNA, 667 bp, Homo sapiens
ccttagctccagggaccagcctactgaacatcgaaaaggtcaggaacgagatcacgggactgagacggcgagccggctagagcggatagagccgtactgccgctctagtttttcttttgctctctatggttaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422184 - DNA, 907 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 422185 - DNA, 1708 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaaaaaaaaaaaaaaaaaaaaaaaaaaaaaaaaaaaaaaaaaaaaaaaaaaaaaaaaaaagggggggggcgccaaaaaaaacccccgggggggccccatggccccccttttttggtacagggggcccccaaggggggtaatataaaaacgcgaggaggcgggggcggagtattaaacacaacgcgcgcgggaggggggaacacaacgcgtgcatggcgggagactcttttgcggagaaaggagccccccatcacgtgtgcgggcggggggggaccacatgatggtcggaaccacccccctcacacaagaaatattaacggagccaggggggaaaacaaaaaaccatagggggtgtcctcggcggtctcaacccaaccgggcgtcatattgtgtggggcaagaaaaagttgggccacgcgcgatttgtctgctgccaccaactttcctccggcaggctccgccacacttataacaaaccgggagaataagaatgacaaacggaagacgagcaaatatagtagagcagaaggagaaggaggacagcacatcatcgacgaaagcacgatggagagagagtgcaacacgacagcaaacgaacaaaaacgctaagaaaaacacaacaggatgaaaagcagcacgaagtacacagcaaagccggagcaagaaataccgaaaaaacagaaggaaacgtgcgaaatcacaatgaaagatcagggccacaagagaaaagaccgtgcaggcaaaatcgatgatgccagagcgacagcacatgccacgctcgtccccacagctctc

SEQ ID NO: 422186 - DNA, 1073 bp, Homo sapiens
tccccttatctgttccttagtctcctttgtatattccttaatgttgggagttctttgagattatgttctgtgcctttaagttacacattctgcctgaacaatcttaagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgaaaaaaaaaaaaaaaaaaaaaaaaaaaaaaactgtgtggtggggcgcgcccgtgggccctctggaaaagagcttttcgaagacccatgcgcgttgggggcgcgcgggggcccccaagtggggttagcgtggaaccgggcgccaagaggcgtgtcccgagaggggac

SEQ ID NO: 422187 - DNA, 2237 bp, Homo sapiens
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaaaaaaagggggccgctaaattccgagggcagtaacggacccgttttgaaaagggccaaggaggataaaaaggacgcgcggtaacccgtggaaagccggctggcggaccccttgggcatggcccggaacggaaaaggtgaacgacggggggta

SEQ ID NO: 422188 - DNA, 2031 bp, Homo sapiens
gtgacgcgtgggtcgacccacgcgtccgggcagaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaa

SEQ ID NO: 422189 - DNA, 2005 bp, Homo sapiens
gcaccggcgaacctgcctgggcaggcagctcgcgcaggacggggcgggaccagacagttgcgcgcacagaaggctggcgtagcaggtaagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaa

SEQ ID NO: 422190 - DNA, 1643 bp, Homo sapiens
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagactggggggcggagcaccagggggggggactcccacgccggtagggagaccctggaggttgacggaacaagggcgaggggaggcgaaaagggggctccaccggcggcatcgacacaggaaacaaaattgtg

SEQ ID NO: 422191 - DNA, 1935 bp, Homo sapiens
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaa

SEQ ID NO: 422192 - DNA, 1948 bp, Homo sapiens
cacccccctcatcccatctcacacgtaccgctagccagccgcggttgaatcggacgaggagaagatggcagctaccatgttccgggctacgctgcggggatggagaaccggtgtccagcggggctgcgggctacggctgttggtgagagcgctgagcgaggagctgagggcatcgcgtgggtaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaa

SEQ ID NO: 422193 - DNA, 1090 bp, Homo sapiens
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctactcagaaggctaaggcaggaagatcgcttgagcccaagagtttgaggctgtagtatgctgtgagtgcgcctatgagtgccaactgggcaacacagtgagacccctgtctaaaa

SEQ ID NO: 422194 - DNA, 823 bp, Homo sapiens
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggacctgtgacacaaaccccaccaattgttaatgcaagtttttatttggctgtatatacaatttaagctattaaaatttgtacaatatttacaaattaaataatcatctgaaa

SEQ ID NO: 422195 - DNA, 2086 bp, Homo sapiens
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaa

SEQ ID NO: 422196 - DNA, 2059 bp, Homo sapiens
cacccccctcatcccatctcacacgtaccgctagccagccgcggttgaatcggacgaggagaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaa

SEQ ID NO: 422197 - DNA, 2568 bp, Homo sapiens
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaactgtctccaacaactcttgtaacacaaaaccaaggggaaaagacaggggcaggcaggtcccagctcctgtggtccctccttggcacagagccttttctaaactggaaagaccaggagtctggcactcctgttcctctttcccgggattaagcattcaacttcaaaagacaaaatttaagccaaaagacactagtaaggaagtaattccaattctaaacttcagaagttctgccagttgagaagtggccttccttgggcgctgggattgcagtggtcaggagcaggcgcactggcccttgcctggagtgcggctgggcagtggctgctgggtgagacaggtcagtctcacttgagaagctgcagaggaaaggggcctggggggaggggcggggcagggtccctcagtgctgcccgcctgcacccccactcccaggcattcctttccctgagttgtgtggttgccagtaagacgcagaaatgcc

SEQ ID NO: 422198 - DNA, 1854 bp, Homo sapiens
gcaccggcgaacctgcctgggcaggcagctcgcgcaggacggggcgggaccagacagttgcgcgcacagaaggctggcgtagcaggtaaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaa

SEQ ID NO: 422199 - DNA, 1061 bp, Homo sapiens
  misc_feature (977)..(977): n is a, c, g, or t
  misc_feature (980)..(980): n is a, c, g, or t
  misc_feature (986)..(986): n is a, c, g, or t
  misc_feature (990)..(990): n is a, c, g, or t
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagccgntangggttncggncccccaagcgtatttggtttgaagaggggccaaatggacggggaatcgctgagtgcccctgttccctggtg

SEQ ID NO: 422200 - DNA, 1035 bp, Homo sapiens
gcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggccgagtttctcctctaactggcggtcttggttgaagagccactcgtgccgtgcgggcggatgttggccaacggatcacctggacaggtttctggcaagctgagagggggatgaggcccaaatgcatgtttgtaaaagggcacggcgggcaccaccagggccggccacgatgacaacagggtggcaaatggaccgagcggctccaccgaggcag

SEQ ID NO: 422201 - DNA, 658 bp, Homo sapiens
cacccccctcatcccatctcacacgtaccgctagccagccgcggttgaatcggacgaggagaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaa

SEQ ID NO: 422202 - DNA, 462 bp, Homo sapiens
taaagtattattaaaatataaaggaccaaatagtgatccttgtagaacttgagggattctgagaaatagttgaaatgacactgtctcagggttaggtagactggagagcccaacgctgatgaggcagaggaatgtgtgcagccactgctatcctgggtcagcaaaatgagggtacatgatatataaagatgacctcccaagaaggacaagtctgtaagacaaaggcccaagagatccccacctgtcctcaggaatgctgtgataccaacacctaccttcaaggcctcactcatccctcggccaatcacaagagtctgtacacccttctcaacaacttccttcacatctgcaggctgcacaccaggagaatgctggatgtggaaagagaaagtagacagatggagtctcactctctcacccagagctcacattctagtaaaatgaaacaagaggccactgact

SEQ ID NO: 422203 - DNA, 205 bp, Homo sapiens
ctcagttcctgtttctctccaatcccaagtccgactaccccctggccatactttgcagtccttataggttgtattagagccttttactttcatttgcccccatgataaggaagcaatttcaggggaagtcataaggaacttcactgaagtccaccgaactgtctcctcaaagttgcgttcccaaacggcgcagtgctctgcccgc

SEQ ID NO: 422204 - DNA, 1009 bp, Homo sapiens
ggtttttgtgaacactttgtagagagtagaggattgagaaatttcagaaagctgttttaggcatcccttgtgccatttaagtggatatagtcattttacaattaacatatttctctggagtagaagaaaggctacaatgggagtgattgaggaagataatccactatcaacagtacatatggtagatgtatattagatcagggaggatgtgagaggtgatagaaggctcaagaatgaaccccaggaaacaccaacaatgaaagggcaaggaaaatcaccatgaaagatactgaagaggagcgaagtggtgggaggaacaccaggaggtagtggaatcacagaaactttgagtttgggaagtagggagcttgggggaatgatcaacagtaacatgctttagagatgtcaaggaggattaagattgtaaaactgggtttgatatccttagtaaaagcagtttcattgcagtacaagactataaataagtaccaaatgaatgggaaaagtgacagcgagtgtccgctacgagtaagcttaggtgggaaggggaaaacagcaaaagctagaagggttggagcagggatgttatgttgtgtgagtgcacacatgcccttgtattcgagttatgaggcacttgagagtgtggttaagatcctgagctctggagtcagacttcccaaattccagtctggactctgccacttgcagctttgtggccttagataagttacttagcttcagtgactcagttttcccatggctaaaatgggaatgatcaagttttgagaattaaatgctagtgcatgttaggtgctataaatagcatataataactgctgaaaagtgtaaactattattgtaattattagtaagaaaatgtttaattattaattttttatcattgacctttaaatatacttgcttcagttatattttaaactttaaattattaacaatttgggccccatgctgtgtagcaggaggaactactgttataccacttaaattt

SEQ ID NO: 422205 - DNA, 3731 bp, Homo sapiens
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcaatatagcagagagtttttgttggttcttagacctcaaacgaatcattgggtataacctccagcctcctgcccagcacaggaatcggtggtctccacctgtcattctagaaacaggaaacaccgtgttttctgacacagtcaattctgattttctttttcttttgcaagtctaaatgttagaaaactttctttttttggagatagtctcattctgtcacccagactggagtgcaggggggcaatcacggctcactgtagtctcgacctcccaggctcaagctgtcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctag

SEQ ID NO: 422206 - DNA, 3860 bp, Homo sapiens
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcaatatagcagagagtttttgttggttcttagacctcaaacgaatcattgggtataacctccagcctcctgcccagcacaggaatcggtggtctccacctgtcattctagaaacaggaaacaccgtgttttctgacacagtcaattctgattttctttttcttttgcaagtctaaatgttagaaaactttctttttttggagatagtctcattctgtcacccagactggagtgcaggggggcaatcacggctcactgtagtctcgacctcccaggctcaagctgtcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctag

SEQ ID NO: 422207 - DNA, 2085 bp, Homo sapiens
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacacttgtccccccaaacttcaagtg

SEQ ID NO: 422208 - DNA, 348 bp, Homo sapiens
  misc_feature (341)..(341): n is a, c, g, or t
ggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaaaagaggcctcttagtctctgcagaaacaaggagtaggacaattcactcttggaagctagaaaggaggcttgagcagcagcagaagncgggtgc

SEQ ID NO: 422209 - DNA, 3953 bp, Homo sapiens
  misc_feature (3456)..(3456): n is a, c, g, or t
  misc_feature (3476)..(3476): n is a, c, g, or t
  misc_feature (3505)..(3506): n is a, c, g, or t
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcaatatagcagagagtttttgttggttcttagacctcaaacgaatcattgggtataacctccagcctcctgcccagcacaggaatcggtggtctccacctgtcattctagaaacaggaaacaccgtgttttctgacacagtcaattctgattttctttttcttttgcaagtctaaatgttagaaaactttctttttttggagatagtctcattctgtcacccagactggagtgcaggggggcaatcacggctcactgtagtctcgacctcccaggctcaagctgtcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgtataggaaaaaaatttttcccccccccccccccaaaanaaaaaaaaaggggtttttcnccccccccttggggggtggggggggtttnntttaaaaaaaaacccggggcccccccttctttcccaatttttttaaattaagaaaatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctag

SEQ ID NO: 422210 - DNA, 3419 bp, Homo sapiens
actataaagacacatgcacacgtatgtttattgcagcactattcacaatagcaaagacttggaaccaacccaaatgtccatcaatgatagactagattaagaaaatgtggcacatatataccatggaatactatgcagccataaaaaaggatgagttcatgtcttttgtagggacaaggatgaagctggaaacaatcattctgagcaaactatcacaaggacagaaagccaaacaccacatgttctcactcataggtgggaattgaacaatgagaacacttggacacagggatagccattaggagaaatacctaatgtaaatgacgagttaatgggtgcagcaaaccaacatggcacatgtatacctatgtaacaaacctgcacgttgtgcacatgtaccctagaacttaaaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcaatatagcagagagtttttgttggttcttagacctcaaacgaatcattgggtataacctccagcctcctgcccagcacaggaatcggtggtctccacctgtcattctagaaacaggaaacaccgtgttttctgacacagtcaattctgattttctttttcttttgcaagtctaaatgttagaaaactttctttttttggagatagtctcattctgtcacccagactggagtgcaggggggcaatcacggctcactgtagtctcgacctcccaggctcaagctgtcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctag

SEQ ID NO: 422211 - DNA, 1673 bp, Homo sapiens
ggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctag

SEQ ID NO: 422212 - DNA, 1049 bp, Homo sapiens
  misc_feature (1042)..(1042): n is a, c, g, or t
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaaaagaggcctcttagtctctgcagaaacaaggagtaggacaattcactcttggaagctagaaaggaggcttgagcagcagcagaagncgggtgc

SEQ ID NO: 422213 - DNA, 552 bp, Homo sapiens
  misc_feature (545)..(545): n is a, c, g, or t
cacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaaaagaggcctcttagtctctgcagaaacaaggagtaggacaattcactcttggaagctagaaaggaggcttgagcagcagcagaagncgggtgc

SEQ ID NO: 422214 - DNA, 325 bp, Homo sapiens
tgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatata

SEQ ID NO: 422215 - DNA, 3768 bp, Homo sapiens
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcaatatagcagagagtttttgttggttcttagacctcaaacgaatcattgggtataacctccagcctcctgcccagcacaggaatcggtggtctccacctgtcattctagaaacaggaaacaccgtgttttctgacacagtcaattctgattttctttttcttttgcaagtctaaatgttagaaaactttctttttttggagatagtctcattctgtcacccagactggagtgcaggggggcaatcacggctcactgtagtctcgacctcccaggctcaagctgtcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctag

SEQ ID NO: 422216 - DNA, 706 bp, Homo sapiens
  misc_feature (647)..(647): n is a, c, g, or t
  misc_feature (671)..(671): n is a, c, g, or t
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagntttctggcatttctagagaaacanggtcctaaactttgagaacatagagaatacaaaga

SEQ ID NO: 422217 - DNA, 3952 bp, Homo sapiens
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcaatatagcagagagtttttgttggttcttagacctcaaacgaatcattgggtataacctccagcctcctgcccagcacaggaatcggtggtctccacctgtcattctagaaacaggaaacaccgtgttttctgacacagtcaattctgattttctttttcttttgcaagtctaaatgttagaaaactttctttttttggagatagtctcattctgtcacccagactggagtgcaggggggcaatcacggctcactgtagtctcgacctcccaggctcaagctgtcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgtctcgctctctcacccaggctagagtgtagtggtgtgatcttggcttactgcaaccttcgtctcctgggttcaagcgattctcctgcctccgcctcctgagtagctgggattacaggtgtgcaccaccatgcctggctaattttcatatttctagtagaaacagggttttgccattttggccaggctggtctcgaactcctgacctcaagtgatctgcccactttggcctcccaatggaatgaaccattgtgtctggcctcattcattctttctttcataaaagtttggatactgccaaacaaaattaaagacatgaagacatttgataaattgttattacaaatgtgacagttatttaactactggtgtttatttttattagagtcatagcacctactggcctctgcttcagggattcacaatggtgttgggcaggttggatatcatggggcttacccttagcaaggcattctattccacctatgcccaggcggtgtaaaacatataagcatctggtacgctgtggtaccgac

SEQ ID NO: 422218 - DNA, 968 bp, Homo sapiens
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctgggagtgcagtggtgtgatcttgggctcactgaaacctccgcctcccgggtttcaagtgat

SEQ ID NO: 422219 - DNA, 1633 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422220 - DNA, 784 bp, Homo sapiens
ttttttactagattagcaatcaaacaaaaatttaattatcgaaagtcaattaagtactaaaacacacacatacatacactccctctctcacacatttcaaaaataagatgcaaggcacataagcagcattatatcaaaccagaatgcattaggatattgattatatttaaataattatttttctttttccttctgtaggtgacgatggcttaatagaatttaccacagttactttagagtctccgaaagcatggctggtggaggcctgactgggaggcaggggatgcgactccttactttgcaaaggctcctctgagccttttgcaacaccaggacttgattggtcagttttcaagacatagcctgatccaaagagttcttccatgagactgcttttcttatctctgaaagttgtatccttcacttttattctggaagacttaccaaatgagggctcatacccactgtcagaatgctctagctccatttcctctctgttactgagatgcttgcctgtactatgactgtacctcatgttgccggcattggctggcccccctgaagcaggaagcccatgatgcaggttttcagttgcttctgtgaatgagtaatgtcttctttgtctgagggggcctttcgtgtagggagcagtgcctttgccaagtgtgtcatccacaccatttctctgcatgcttcttttaaacttttctcttactagaacatcttcttgattgctttctctttcaggatgaataacttcaattatttttggtggtagttcttg

SEQ ID NO: 422221 - DNA, 370 bp, Homo sapiens
attcaaggtttcaccaagggacattagtggctgtgcgtgctcatctgttgtctgtggggactgggttcctaggcttgaggtgctcagtctggagagttttcctggttttattttcgcatttccctgtcctcccttctgtgtggtcggttgtgtgattggcaggctgctttgctcaccagaggtgtctttacaggctgccctgatgatctcactcatttggaagtattattctgtccctgtggctgtcgtgccgagtaaatggataacccctctagaccgcctggtagcctttcctactagagtagcaggtaagaattttctggaagatgcagtggaagagtgcgataggcttatgtaggggtggcggtag

SEQ ID NO: 422222 - DNA, 726 bp, Homo sapiens
ctcaatctgagtcggatactattttaaataatggcataatgagatggtgggtgacttaaaaattctattttatattttctaaatatgttgagcgattgttccatttataatcagaaagtgtattataagggaaaataacatttctgtgtatttgaatattttgttaatttttcaggactgacataattatttatcctgtttttcctttcagtgaaagctcggacagctcaattagccaagataaaatgggtgataagtgtcgctttctacgtattgcaggtaagtgtgctagagcgtcagccgggtcattggagttggtgaccccggcctccagagccgtgtctgcagatccagggctgggagttcgggctgttccaccttcagctgtcgtgtcgtgtgtccctgcccacatggagctctaaacactctcggtctctaagtcagactaaaaggaagcctttctcttgaggagagttgttaaagtttgggactttttggcagatggactgtgaagtaagttctcggagagctttcaccatgcctgcatcccagtgtggtttgaagggcctggtgggatgaagcgagaggcttatagatgacatcagttttttctgagatcttcaatacttttggcccttacttgttacctggtgtacttcatgcacgctctccaccctccaggtagagaaccagcttttccgactggaattggcttctagcctccct

SEQ ID NO: 422223 - DNA, 413 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcaagtccaggggtcttcagaagggcgccgagagggagttacaaaattaaagccgggatcacgacataagcagggctttcccaataaacatgttgcgggttttcaaatttcacgttgaagaaagttcacagtgcggtatcttcacccctttactcgccagtctattgccg

SEQ ID NO: 422224 - DNA, 1484 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaaattaatctgaaccaatacaaaagaaaaaaaaaagtggtcgcggccgccaatttaacttta

SEQ ID NO: 422225 - DNA, 1474 bp, Homo sapiens
gagacaccctcaggcgactggcgggtcgcggcttccaagctctaaatggagagttgtccctactgtgcggcaggcggaggagacctatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422226 - DNA, 1703 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcgtaagtggctgcctggcctcccaagggccggtggggatgccgccccagtcccccggcgggtctggcgtagatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422227 - DNA, 1580 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422228 - DNA, 1807 bp, Homo sapiens
gggcttacgggccgagtgccctttgagattcaactttttctaaattatccttcactttctgctgtaaagagtggccacctcctttttcctctaggggactgaagcgagaggaggatattgcagggtttgcctctgtggtcatcttcttagagagcaccccctccgcccccacacccttttcctcagagccgttgcttagtgagtccctgccatggaccaggcttgggaatggtccccaagtattagtttaggaggacgactctctgcttcacaggacctaccccagaatcctgtgactcagaagcgcgcttgtgaagtgcgcatgtgcgggcagggcctccagtggggctctcgtgggggcagcagccaaggactggggctggtggcctggagagctgcccgcttctccgcccttgccgatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422229 - DNA, 2246 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatggtactgtgtcccttgcagcctggaggcttcatgagagcggatgaatagagaagtctgtatgtgaagattagtagaatacatactttgcttcttggatgttctgaatattgatggaaacttaagttatctggaggaaactcagtaataagtattactttcctcttatttgctggtgaacctttgctttctaagcacagaaatatctaagatcctctcagattttcctcagagccaactctttaaaattttaagctaactcttaaaaattgtaggttttcatttttaaattcatcacttttctgagagaagcccagaaaaaaagtctcacagtggattcccagaggcttttgttccactctctagaaaaatgcccagcagtgtcctcttctgagtgtcacctcccgggtccagtgtcctgtgatgaagagcgctttctcagggcagcccgtgtgctgagggaccccggtcacagtgtgtgcacagtcagagagctgtctctgtggctaggaaaacagacagaggggcctgtccaggcccaggacaagctggactcccaccaggggttcgtgtactgtgcacactgggaaataaggaggaaaatttagtcctgttgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422230 - DNA, 1130 bp, Homo sapiens
  misc_feature (25)..(26): n is a, c, g, or t
gagctgtcagaggatccccctagtnntgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422231 - DNA, 1420 bp, Homo sapiens
gagacaccctcaggcgactggcgggtcgcggcttccaagctctaaatggagagttgtccctactgtgcggcaggcggaggagacctatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataatcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422232 - DNA, 1518 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422233 - DNA, 1125 bp, Homo sapiens
gagacaccctcaggcgactggcgggtcgcggcttccaagctctaaatggagagttgtccctactgtgcggcaggcggaggagacctgtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422234 - DNA, 1137 bp, Homo sapiens
gcggccgccgcggggccccggcggcgggggcacggtcccccgcgaggggggcccgggcaccaaaatgggtgataagtgtcgctttctacgtattgcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422235 - DNA, 1166 bp, Homo sapiens
cgagcggccgcccgggcaggtacacttaccatgttacgacttgtctcctctatataaatgcgtaggggttttagttaaatgtcctttgaagtatacttgaggagggtgacgggcggtgtgtacgcgggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagatttttttttggttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaaaaaacaa

SEQ ID NO: 422236 - DNA, 1180 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtgacgatggcttaatagaatttaccacagttactttagagtctccgaaagcatggctggtggaggcctgactgggaggcaggggatgcgactccttactttgcaaaggctcctctgagccttttgcaacaccaggacttgattggtcagttttcaagacatagcctgatccaaagagttcttccatgagactgcttttcttatctctgaaagttgtatccttcacttttattctggaagacttaccaaatgagggctcatacccactgtcagaatgctctagctccatttcctctctgttactgagatgcttgcctgtactatgactgtacctcatgttgccggcattggctggcccccctgaagcaggaagcccatgatgcaggttttcagttgcttctgtgaatgagtaatgtcttctttgtctgagggggcctttcgtgtagggagcagtgcctttgccaagtgtgtcatccacaccatttctctgcatgcttcttttaaacttttctcttactagaacatcttcttgattgctttctctttcaggatgaataacttcaattatttttggtggtagttcttg

SEQ ID NO: 422237 - DNA, 1060 bp, Homo sapiens
cccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatggtactgtgtcccttgcagcctggaggcttcatgagagcggatgaatagagaagtctgtatgtgaagattagtagaatacatactttgcttcttggatgttctgaatattgatggaaacttaagttatctggaggaaactcagtaataagtattactttcctcttatttgctggtgaacctttgctttctaagcacagaaatatctaagatcctctcagattttcctcagagccaactctttaaaattttaagctaactcttaaaaattgtaggttttcatttttaaattcatcacttttctgagagaagcccagaaaaaaagtctcacagtggattcccagaggcttttgttccactctctagaaaaatgcccagcagtgtcctcttctgagtgtcacctcccgggtccagtgtcctgtgatgaagagcgctttctcagggcagcccgtgtgctgagggaccccggtcacagtgtgtgcacagtcagagagctgtctctgtggctaggaaaacagacagaggggcctgtccaggcccaggacaagctggactcccaccaggggttcgtgtactgtgcacactgggaaataaggaggaaaatttagtcctgttggtaagtggtaactgtattatacaaagaatctttgat

SEQ ID NO: 422238 - DNA, 529 bp, Homo sapiens
tatataagatataatagataaaaacagaaagaaagataaaaaatagaagataatctacagacagtacagtggccttggtcttggaaactgaagggagaaggtctggcccccagggtggggctctcctttccctcccccagccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtgactgcaaatgcttctttccccagctcttgg

SEQ ID NO: 422239 - DNA, 485 bp, Homo sapiens
  misc_feature (93)..(94): n is a, c, g, or t
tacatcacagcaagtgacttctcagaggggaaaagccaagctccagacaaggagtgttgttaaaatgtatcttatttcctttgttttaatatnnaaccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtgactgcaaatgcttctttccccagctcttgg

SEQ ID NO: 422240 - DNA, 3669 bp, Homo sapiens
ctgcctgggccagagccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaaggtgggtgggccaagcgcaatggacagagcaggaatgataccaacatgacgcactcaggagcctcctgcccagttagaggagtggggaggctggccaaggctgagacttcgttggggtgggctcaggtctggaaggggggtaccctggaaggccatgatgacaataacgatgggatatttatgtcttcttcaaaggacttaaatgagatcacgtaaacaatataataaaaatcataactaacatttattgagtgctaactgtgtgccaggcctttattaactcatgtgatcctcaaagcgaggttggctctgtcattgtcatcgttttacagatgcagaaactgaagaacagagaacttagatagctcatgcaagatgacaacacagcaggaggtgacagacactttatttcgttaccgtgagataatatttcaaataagtgtatgggaaagaaagttagaaaggggaaaaaatggcagccggaaagataagggagagccaggtgaggtcccaactccaagtacaccatgggaggtcctaagcaagggacatgcagaggggagatctgagcttcccagcaaccaaggcaaaaaagtgtcaatcagtcacactcttcacaagtgcctgccagagactataacccacatactcatgaaagggccagacagccctgacgttaagatctgggagaaattttaggagaggatcctatgcctcagcagttcgtagaagtttcagaggctgtcagaaaacatcccaagtgttagcggtagcctttccctccagcagtggtcagtacttaaagcatttctgttgggtgacagcaaagctgttagcctctctggcctcatggtggggagggactgctgtggagactccacaggaaggagggagccaacagcgctacagggaggctccttctacagttgggagctatttctggtgctctggctgggcatgatggctcacacctataatcctggcactttgggaggccgaggcaggaggatcccttaaggccaggagtttgataccaaaccaggcaacatagtgagacctggtctctacaaaaatatttttaaattagctgggtgtggtggcgtgtgcctataatctcagctacttgggagtctaaggcaggaagatcacttgagcccaggagttcaaggctgtagtgaactgtgatcggaccacggcactccagcctgcgtggcaaagcaagaccctatcgccaaattataataaagaaattctggtgtgcctctgagtcacaccagctgggaacatgctttggcagtaaccaggtgagctgacttgccacgtgggattatttactggaatgcagtcaggcacgcgggaacagctgcagtagcttaactctggttttggaacagctgaccagtgaatggcctgggttttctggcagaaacaggtatctcagttgttttgttttgtttttcagttgtctattaaggttgcttccagtagacgagaatgaaaccccgtcggctgctcttggtagctccttgctactcaaaatgtggtaggaggatgagcagcctcggccccacctgggatcttgctggcctctcagctccacccacacctgctgagtcagactctacacttcaaaaagatctctgggccatttgttgcagtcaagtttgagacccactggaccagactagtgcctcagagtctcctggagggcttgttgaaacaaagtgctggccccacccccagagtttctgattcagtagatctggggtggggtctgagacgctgcctttcccacaagttcccagttcttagcaaagcagccgctggttcagggacctcatgttgagaacctttgatccagactgcagagggctggctggcaaatcagctgcatgttgggagtcacctgaggaatgttttaaatgctgatgcctgagtttggacctgaggttcaaatgtaagtgatctggaatgtggcctgggatcaggatttttgtaaagcactttgggtgagtccatgtgcagtagattttgagagctgtattctagtggatctgccctgttgctaacccaccagaaggaaccagagcagaacgtgcccttttggaaataactgggaccatgaagagactgtcagtgttacagctcttttagaatttgttaggctgggcgtactggctcacgcctataatcccaacactttgggaggcaaatcccaaggtgggcagatcacctgaggttgggagttcgagaccagcctggccaacatgatgaaaccccgtctctactaaaaatacaaaaattagctgggcgtgttggcacatgcgtgtaatcccagctactcgggaggctgaggcaggagaatcacttgaacctgggaggcagaggttgcagtgagccgagattgtgtcactgcactccagcctgggtgacagagtgagactttgactcaaaaaaaaaa

SEQ ID NO: 422241 - DNA, 2623 bp, Homo sapiens
ctgcctgggccagagccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaaggtgggtgggccaagcgcaatggacagagcaggaatgataccaacatgacgcactcaggagcctcctgcccagttagaggagtggggaggctggccaaggctgagacttcgttggggtgggctcaggtctggaaggggggtaccctggaaggccatgatgacaataacgatgggatatttatgtcttcttcaaaggacttaaatgagatcacgtaaacaatataataaaaatcataactaacatttattgagtgctaactgtgtgccaggcctttattaactcatgtgatcctcaaagcgaggttggctctgtcattgtcatcgttttacagatgcagaaactgaagaacagagaacttagatagctcatgcaagatgacaacacagcaggaggtgacagacactttatttcgttaccgtgagataatatttcaaataagtgtatgggaaagaaagttagaaaggggaaaaaatggcagccggaaagataagggagagccaggtgaggtcccaactccaagtacaccatgggaggtcctaagcaagggacatgcagaggggagatctgagcttcccagcaaccaaggcaaaaaagtgtcaatcagtcacactcttcacaagtgcctgcggtgggaggaaccaatctgcagcgcagccacccccaaggctggatccttaagtgaaggaccaagccaggcctcagggtgactgtgatcaggactgaggggtggacaaggtggcccaagtatggcttccagaccccgaagccccacgacctcccaggtgcccgccatgatgaccctcaggtggcagtgaccccgtcactgtataagacattttctcctgctgagcagaaggcatcatcccctgcaactacctcttcccacgtctttctcccctggtaccaaaaagaaccctgtacctctcctcctcctcctccctcctgccagtgcagtggccttggtcttggaaactgaagggagaaggtctggcccccagggtggggctctcctttccctcccccagccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtgactgcaaatgcttctttccccagctcttgg

SEQ ID NO: 422242 - DNA, 3775 bp, Homo sapiens
ctgcctgggccagagccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaagaccccatgatggagctgacaggcactgacccttcagagctcgacggccagcaggagatggaggacttcgaggagaacgcctacagctatgcgagcgtggacagcagcgccgaggccagtgtcctcactgaacaggccatgaaagagatggcctactacaacgtgctatagcgcaagctgggccacccctaacgggggccgggggcgagggcatgggggtgagacccatgggctgcaggctgcacctcctgcagccgagaaacaagctactgccccactgttctgagccctccctccccgagtcatttgcaccactagggacctttagaccaaatggagactgtactactggccccggctgtgagccagcacaggcccaggcatcccagcaagggaaggagaacacgcgaggcccagatctgggtctccctggcctgcttccgtggggagtgggagaagtggggccactggggacaggtcacaagggcaccggccctcggggtctctccaggcccagcagagctcttcaggggtcctgacactggaagaagagaccacttgagccatgtctttttcacggccaactcctgcctctaaggatgtctgagctcccctctggccagtactgcccacctctaccttgtccaggcccccttccccgccctgtcgacggaccgccaggcagggcactctgccttctacctcccggggtctcccatgcgctcctcaagccaggtgtgcacgtggccctggccctggcctgcaggacagctggggggcacccagcccccagaagacccctgtcctacatccctttctggaagtgagtgtccctacagtggattgcaacacatgtcgtccacttcgaccctagctggagtgcctcaccagggggcccactaggaacaaagccaggacaggcccgcgtcaggcacacactaacaaaaccagaagcatggggcagggcagggcggagtgagggctcacaggggaccaagaagggctgtccttggggggggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaatcaagggtttttttgagcaaagggggtcttctgaaggtaacttattatttttttctttccaactgtgtgtcacctatgaccttttctgatggagatgcattttctttttccaagcgtaagcttcctaatgtgctgtgcgtgcttcctacccacccaccccgagcagcctggccgggcaggactggggctccatggggactgtcaccctggccctggaggtgcagccgctggcagcagcctcagcaggctggggtgggaggcaggagaaggcagagctgggaagccctccacccctgcctggctcctgcagtcgctgacttgctctgtcccatgtcccatcctcggctgtcagggctgctgactctgctcagccaacagctagctccctcgctcgcctgctctcttcccctctgttcccacgccagctcctgcccctggaaccagagatgacaggcccagggcagtgaatagcacattcaggaactctagggcacccggacccccccacccacttgcctcctgaggcctcagtggggaggggcaagcaggggtcttccccaaaggcacagatgaagccactagcttcagcctagaaacccggagaagggaacagcctgcggtgggaggaaccaatctgcagcgcagccacccccaaggctggatccttaagtgaaggaccaagccaggcctcagggtgactgtgatcaggactgaggggtggacaaggtggcccaagtatggcttccagaccccgaagccccacgacctcccaggtgcccgccatgatgaccctcaggtggcagtgaccccgtcactgtataagacattttctcctgctgagcagaaggcatcatcccctgcaactacctcttcccacgtctttctcccctggtaccaaaaagaaccctgtacctctcctcctcctcctccctcctgccagtgcagtggccttggtcttggaaactgaagggagaaggtctggcccccagggtggggctctcctttccctcccccagccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtgactgcaaatgcttctttccccagctcttgg

SEQ ID NO: 422243 - DNA, 3557 bp, Homo sapiens
ctgcctgggccagagccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaagaccccatgatggagctgacaggcactgacccttcagagctcgacggccagcaggagatggaggacttcgaggagaacgcctacagctatgcgagcgtggacagcagcgccgaggccagtgtcctcactgaacaggccatgaaagagatggcctactacaacgtgctatagcgcaagctgggccacccctaacgggggccgggggcgagggcatgggggtgagacccatgggctgcaggctgcacctcctgcagccgagaaacaagctactgccccactgttctgagccctccctccccgagtcatttgcaccactagggacctttagaccaaatggagactgtactactggccccggctgtgagccagcacaggcccaggcatcccagcaagggaaggagaacacgcgaggcccagatctgggtctccctggcctgcttccgtggggagtgggagaagtggggccactggggacaggtcacaagggcaccggccctcggggtctctccaggcccagcagagctcttcaggggtcctgacactggaagaagagaccacttgagccatgtctttttcacggccaactcctgcctctaaggatgtctgagctcccctctggccagtactgcccacctctaccttgtccaggcccccttccccgccctgtcgacggaccgccaggcagggcactctgccttctacctcccggggtctcccatgcgctcctcaagccaggtgtgcacgtggccctggccctggcctgcaggacagctggggggcacccagcccccagaagacccctgtcctacatccctttctggaagtgagtgtccctacagtggattgcaacacatgtcgtccacttcgaccctagctggagtgcctcaccagggggcccactaggaacaaagccaggacaggcccgcgtcaggcacacactaacaaaaccagaagcatggggcagggcagggcggagtgagggctcacaggggaccaagaagggctgtccttggggggggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaatcaagggtttttttgagcaaagggggtcttctgaaggtaacttattatttttttctttccaactgtgtgtcacctatgaccttttctgatggagatgcattttctttttccaagcgtaagcttcctaatgtgctgtgcgtgcttcctacccacccaccccgagcagcctggccgggcaggactggggctccatggggactgtcaccctggccctggaggtgcagccgctggcagcagcctcagcaggctggggtgggaggcaggagaaggcagagctgggaagccctccacccctgcctggctcctgcagtcgctgacttgctctgtcccatgtcccatcctcggctgtcagggctgctgactctgctcagccaacagctagctccctcgctcgcctgctctcttcccctctgttcccacgccagctcctgcccctggaaccagagatgacaggcccagggcagtgaatagcacattcaggaactctagggcacccggacccccccacccacttgcctcctgaggcctcagtggggaggggcaagcaggggtcttccccaaaggcacagatgaagccactagcttcagcctagaaacccggagaagggaacagcctgcggtgggaggaaccaatctgcagcgcagccacccccaaggctggatccttaagtgaaggaccaagccaggcctcagggtgactgtgatcaggactgaggggtggacaaagtggccttggtcttggaaactgaagggagaaggtctggcccccagggtggggctctcctttccctcccccagccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtgactgcaaatgcttctttccccagctcttgg

SEQ ID NO: 422244 - DNA, 2245 bp, Homo sapiens
ctgcctgggccagagccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaaggtgggtgggccaagcgcaatggacagagcaggaatgataccaacatgacgcactcaggagcctcctgcccagttagaggagtggggaggctggccaaggctgagacttcgttggggtgggctcaggtctggaaggggggtaccctggaaggccatgatgacaataacgatgggatatttatgtcttcttcaaaggacttaaatgagatcacgtaaacaatataataaaaatcataactaacatttattgagtgctaactgtgtgccaggcctttattaactcatgtgatcctcaaagcgaggttggctctgtcattgtcatcgttttacagatgcagaaactgaagaacagagaacttagatagctcatgcaagatgacaacacagcaggaggtgacagacactttatttcgttaccgtgagataatatttcaaataagtgtatgggaaagaaagttagaaaggggaaaaaatggcagccggaaagataagggagagccaggtgaggtcccaactccaagtacaccatgggaggtcctaagcaagggacatgcagaggggagatctgagcttcccagcaaccaaggcaaaaaagtgtcaatcagtcacactcttcacaagtgcctgccagagactataacccacatactcatgaaagggccagacagccctgacgttaagatctgggagaaattttaggagaggatcctatgcctcagcagttcgtagaagtttcagaggctgtcagaaaacatcccaagtgttagcggtagcctttccctccagcagtggtcagtacttaaagcatttctgttgggtgacagcaaagctgttagcctctctggcctcatggtggggagggactgctgtggagactccacaggaaggagggagccaacagcgctacagggaggctccttctacagttgggagctatttctggtgctctggctgagccaccgtgctcagccgatgctattttagcaagcatgtattgagcacctactggctttcagtcaatcaagctcaaccttccg

SEQ ID NO: 422245 - DNA, 3333 bp, Homo sapiens
  misc_feature (3264)..(3264): n is a, c, g, or t
  misc_feature (3269)..(3269): n is a, c, g, or t
  misc_feature (3333)..(3333): n is a, c, g, or t
ctgcctgggccagagccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaagaccccatgatggagctgacaggcactgacccttcagagctcgacggccagcaggagatggaggacttcgaggagaacgcctacagctatgcgagcgtggacagcagcgccgaggccagtgtcctcactgaacaggccatgaaagagatggcctactacaacgtgctatagcgcaagctgggccacccctaacgggggccgggggcgagggcatgggggtgagacccatgggctgcaggctgcacctcctgcagccgagaaacaagctactgccccactgttctgagccctccctccccgagtcatttgcaccactagggacctttagaccaaatggagactgtactactggccccggctgtgagccagcacaggcccaggcatcccagcaagggaaggagaacacgcgaggcccagatctgggtctccctggcctgcttccgtggggagtgggagaagtggggccactggggacaggtcacaagggcaccggccctcggggtctctccaggcccagcagagctcttcaggggtcctgacactggaagaagagaccacttgagccatgtctttttcacggccaactcctgcctctaaggatgtctgagctcccctctggccagtactgcccacctctaccttgtccaggcccccttccccgccctgtcgacggaccgccaggcagggcactctgccttctacctcccggggtctcccatgcgctcctcaagccaggtgtgcacgtggccctggccctggcctgcaggacagctggggggcacccagcccccagaagacccctgtcctacatccctttctggaagtgagtgtccctacagtggattgcaacacatgtcgtccacttcgaccctagctggagtgcctcaccagggggcccactaggaacaaagccaggacaggcccgcgtcaggcacacactaacaaaaccagaagcatggggcagggcagggcggagtgagggctcacaggggaccaagaagggctgtccttggggggggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaatcaagggtttttttgagcaaagggggtcttctgaaggtaacttattatttttttctttccaactgtgtgtcacctatgaccttttctgatggagatgcattttctttttccaagcgtaagcttcctaatgtgctgtgcgtgcttcctacccacccaccccgagcagcctggccgggcaggactggggctccatggggactgtcaccctggccctggaggtgcagccgctggcagcagcctcagcaggctggggtgggaggcaggagaaggcagagctgggaagccctccacccctgcctggctcctgcagtcgctgacttgctctgtcccatgtcccatcctcggctgtcagggctgctgactctgctcagccaacagctagctccctcgctcgcctgctctcttcccctctgttcccacgccagctcctgcccctggaaccagagatgacaggcccagggcagtgaatagcacattcaggaactctagggcacccggacccccccacccacttgcctcctgaggcctcagtggggaggggcaagcaggggtcttccccaaaggcacagatgaagccactagcttcagcctagaaacccggagaagggaacagcctgcggtgggaggaaccaatctgcagcgcagccacccccaaggctggatccttaagtgaaggaccaagccaggcctcagggtgactgtgatcaggactgaggggtggacaaggtggcccaagtatggcttccagaccccgaagccccacgacctcccaggtgcccgccatgatgaccctcaggtggcagtgaccccgtcactgtataagacattttctcctgctgagcagaaggcatcatcccctgcaactacctcttcccacgtctttctccctgtacngaccntgtacttctctctctcctctgcatgcatgctgggctgactgaggaggctgcccgtggcttcttn

SEQ ID NO: 422246 - DNA, 1144 bp, Homo sapiens
taaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaagcatgtcatggtcatgcatattgatcacaaagtgaatggattcatgatacagggcagatcatgaaatagaagtttccagccccagcagtcctgctcctgtgtatgccttcctcacttttcctgcctcctctccaaacctttgtattgatgtttaatgtgataaataagctttgcctgttccagaatttatgtcaagggaatcatacaatgtgtatt

SEQ ID NO: 422247 - DNA, 926 bp, Homo sapiens
taaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaact

SEQ ID NO: 422248 - DNA, 980 bp, Homo sapiens
taaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaa

SEQ ID NO: 422249 - DNA, 800 bp, Homo sapiens
cgcaagatttaaaagataaaattagcagggtatggtaatgcattaggtatgaaatacagtgagggatctaagctggcaccaaggaatctggtttgggtgtgactatgttgaagatggcaaagtgaactaagattgggcataaaaaaagaccagaaaggtgatgaaacccatttgggatatgctttatttatggtgcctataagacacccaaacagaaatatgtgaaaggtcagggctagggatagagatcagaatatcattcggacaatgaaagatcgttataaccttaggagatagaaggggctgacatggcataaggataatgtggagagaggtgctgagggctaaggaaggaattcagggaaatatcactgctcaaagggtggactgaggaggaggagcccttaaattatcctgggaagcaacagtcaggatggcctgatggagaagcaggagcaagtggagagggcagggagagccttgtgcctgtgtactgactgaggggaagggacctctacatgattctgcccccttggaattagggcaagaacaggaagacagtgagcctgctgccaaagactaggaggatagcggatgctggtgatgcagagtactcaccatcctttctcacctcagatatccgccttgctcagcagcaatcacaaatacctgagcccacataagatatttctcacctagataagaaagccaaaacttctcctttaaattcacccaacaccactcacctcagaaattccctatgtggaaagcagcagcctctcctatggaagcatgaactg

SEQ ID NO: 422250 - DNA, 825 bp, Homo sapiens
aaacaggctccaaaagcttgttacttgcttgtagtcaaacagaaggcagagctgcgaatcaaatccaggtttgtctcgacatgccactagctcatacttcccttggatcagccactaaatggctttcactccagtgagcagcgaccagcaccagaattatggaacatttatcaacagcctaaaataaagacaacacgaggagaatttggttgcttatatagattcaaggtacaatcctgctggattctggaagaaatatcacagtgtgcatgcacagaagtacgaccatgtgaagaggtagcaagagagcagcaatctacaagccaaggaaagaggccacagaggaaaccaaccctgccagcatcttgatcttggacttccagcttccagaactaaccagggaccccactcccatgccgacagtatgggctgctgtcttcaggaccattgcaaggctgcaggaagacttagaggcatcatcctgccttggcttctggttgccaaggtgttctgcctgataccaactttgtcagcagtcaccaactagccatgcttttcccttgaaggcacatgtagattgcctaaccatccacaccaggcaaacaattcttcaaatgtcatgccctttgcacttctgttcagatccagccttagagaagcttgtgaagcaatgactgttttaattggtctcctgggtacccaggcctaatcctttaccaagtcactagttatcccatgttccttatctgtctgtctatccatctatccttccatcctcatccaatacttacagaatgcctatggctgcaaatacaaggatgactg

SEQ ID NO: 422251 - DNA, 342 bp, Homo sapiens
  misc_feature (22)..(22): n is a, c, g, or t
gactcctagaggatccccagcnggggaacaatcacttcatcagaaaaaaaaaattgtcagtgatatgtgaatgaaatgacatttctattttttctgatgaagtgatagataatacaatctaaagtgactttagcaatgtgcttgacttttacttctctctctcaggggatggactatttgggttctcggcaatacgttcaccgggacttggcagcaagaaatgtccttgttgagagtgaacaccaagtgttgttcccgtagcggggaacaatcacttggaaagctcattgattttgtatatgttccacgcgtgtacccctctgcatccagatcccatgtttc

SEQ ID NO: 422252 - DNA, 830 bp, Homo sapiens
aaacaggctccaaaagcttgttacttgcttgtagtcaaacagaaggcagagctgcgaatcaaatccagcaccagaattatggaacatttatcaacagcctaaaataaagacaacacgaggagaatttggttgcttatatagattcaaggtacaatcctgctggattctgggattacaggactgtagacaaaagagaaatcatcatggactgttcactggacaaaatttcatggagaggagaagacctttggcggttcatggatgttctataataagttaggtaactaacaggctaactttcttgagcacctacactgtgtagggcactgtactggtacttctcataccttctctcattcatataatcctctgaggtaggtgttatcctctctacagcagggaaaatcaatacccagagaaggggagagacgtccatggcacacaggagaggacagagccaagaatgaatataggacaccagtgccccaactcttaaccactaccatacacggttttataaagtaaattttaaaagtcgactttaaaacatgtatgcaacattgtgtccagtctcccaaaacaaaagaacaatgagcgttcccttttcccttgatgtgtgggcaggtctgtagagtagtacaagaagagattatgttctgcattctcacttcaacaagaaagtcctggtccaccaataatacctttaagcttcaggataattgtgaaaaggccaactagttaatcaaacattttcccaaacttaagaaaaacaccaagaaggaatataagtacaggggacattagaggataagctcataagggctggacta

SEQ ID NO: 422253 - DNA, 5074 bp, Homo sapiens
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422254 - DNA, 5576 bp, Homo sapiens
  misc_feature (5576)..(5576): n is a, c, g, or t
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagactttaaaaagaaaaaaaaaaaaaaaaaaaaaaaaaaaaaaaaaaaacaaaaaaaaaaaaaacacacgaacacgcaaacacaaacccaacaaccgagagacaacacaacaaaagcaaagaacaaaaaacaaaaaggtgtggccggcgcgctcgcgcgccccaagaagcatctacaccaccaaacgagctgcggtcggagaggcgcgctgagcacccatattagaagtgaacaagtaagccaagagcgctaacgacgtggcatacaaagagagtcaccgctcgtcgtccgacacccaaccctgcgtcggggcgtggaaccacccaaccaaaaaaaacacaacgaggcggccgatgcacgacaaggtgccggcgtcagcagaagcaccacacacacagggagctacgccggtcgtcgagaaccacgtccagggggatacaacacagaaaggagaggacgacaacgagccgcaactacaataataaaccccaggccccgacgggcagaagn

SEQ ID NO: 422255 - DNA, 4768 bp, Homo sapiens
  misc_feature (4678)..(4678): n is a, c, g, or t
  misc_feature (4684)..(4684): n is a, c, g, or t
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgcaaaagaggacagaggataaataaaacacacacgcctgcatatacaacaactagatacattataatgaaatttaaggnaatganagacaaaaagcaaattctaagagtttccaacaaggaagagtaggtcacctataaaggggtacatcggaatgtcatcatatacct

SEQ ID NO: 422256 - DNA, 2063 bp, Homo sapiens
gtgatgggaaaggcgatgatctagaaatgtagatgtgatcagatgtaaaatgtttgtatgtctagcaagtgattgtgccccgacatagcggggaacaatcacttcatcagaaaaaaaaaattgtcagtgatatgtgaatgaaatgacatttctattttttctgatgaagtgatagataatacaatctaaagtgactttagcaatgtgcttgacttttacttctctctctcaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422257 - DNA, 1996 bp, Homo sapiens
  misc_feature (22)..(22): n is a, c, g, or t
gactcctagaggatccccagcnggggaacaatcacttcatcagaaaaaaaaaattgtcagtgatatgtgaatgaaatgacatttctattttttctgatgaagtgatagataatacaatctaaagtgactttagcaatgtgcttgacttttacttctctctctcaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422258 - DNA, 1455 bp, Homo sapiens
tgttgttacttctttctttttacgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422259 - DNA, 3797 bp, Homo sapiens
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaatgttattcatgcttcttattttaaaaggtcgacgcggccgcgaatttagtagtagtagta

SEQ ID NO: 422260 - DNA, 1036 bp, Homo sapiens
caccatctactagggcattattatgcgagaattttcgataacaaggtgttgaccacgattatatcttaatattcttgcctttccccgtggtgtgtaattttttctccctaaattgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422261 - DNA, 2275 bp, Homo sapiens
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaactcttccaccatgatattctccacgtcgcggacacagacgccatagaggtacacg

SEQ ID NO: 422262 - DNA, 1382 bp, Homo sapiens
  misc_feature (1343)..(1343): n is a, c, g, or t
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacaaggagtcggccgaaagtnttttttgttttcatctcctgtgcgccccacgccccgcgt

SEQ ID NO: 422263 - DNA, 846 bp, Homo sapiens
cgcaagatttaaaagataaaattagcagggtatggtaatgcattaggtatgaaatacagtgagggatctaagctggcaccaaggaatctggtttgggtgtgactatgttgaagatgcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422264 - DNA, 500 bp, Homo sapiens
gtgatgggaaaggcgatgatctagaaatgtagatgtgatcagatgtaaaatgtttgtatgtctagcaagtgattgtgccccgacatagcggggaacaatcacttcatcagaaaaaaaaaattgtcagtgatatgtgaatgaaatgacatttctattttttctgatgaagtgatagataatacaatctaaagtgactttagcaatgtgcttgacttttacttctctctctcaggggatggactatttgggttctcggcaatacgttcaccgggacttggcagcaagaaatgtccttgttgagagtgaacaccaagtgttgttcccgtagcggggaacaatcacttgaatctttacctttgggaactagcattcacaaaatggtgaatactaactcttatcctgatttgctacaagaaactagtctagaatgagcagtgtaatttttagcactacactctttctatgcttcacacattacagacttgaagatgaagattctg

SEQ ID NO: 422265 - DNA, 672 bp, Homo sapiens
aaacaggctccaaaagcttgttacttgcttgtagtcaaacagaaggcagagctgcgaatcaaatccaggtttgtctcgacatgccactagctcatacttcccttggatcagccactaaatggctttcactccagtgagcagcgaccagcaccagaattatggaacatttatcaacagcctaaaataaagacaacacgaggagaatttggttgcttatatagattcaaggtacaatcctgctggattctggaagaaatatcacagtgtgcatgcacagaagtacgaccatgtgaagaggtagcaagagagcagcaatctacaagccaaggaaagaggccacagaggaaaccaaccctgccagcatcttgatcttggacttccagcttccagaactaaccagggaccccactcccatgccgacagtatgggctgctgtcttcaggaccattgcaagtgtccttcacggttcggttcacatttcacaagccccatgaagtctatctggattttcgatggatgtcttgccttttcctctacacactacaggaagagtggccacccctgccaagggcctagtatagtaccctatacatgtagctgatcagttgattgttactgatcatatgtatcctgcatcatgttataaaaaattaacacagtgcttggcacata

SEQ ID NO: 422266 - DNA, 511 bp, Homo sapiens
cccccccgttgatcgtccacaacatacagaatggctgtcatggtccaatctggttggtcctagaaccttatcagttgcctttggtgtgcagagagcccgtgttttagtgatggggcatgtcatcattgtttaggtcaggccagttgaccatgctgcctggtacttgttggctgtcctcctttcctccctgctgtccaagctctggtcaggccttcctgtaatctcctaccatcctctttgcagcagcccctcaatgctgcttctttacttggatctctcttcatagtttaaccccctcacctctccatagctgatcaagaagtactacactttctgatttcttgctgtgtcaaacaatgtgggcaattcaagaaacactgaacacagctgagcgtgctgccatgtgcctgtagtttcagctccttgagaggctgaggtgggaggatcacttgagcccaggagttcaattctagcctgggcaacatagcaatatcccatctctaaaatatat

SEQ ID NO: 422267 - DNA, 619 bp, Homo sapiens
tacctgaatgtcaagagctaaaaaacaaaacaaacaaacaaacaaaaatacttttctcagtttttgccaattgggcgtgtactggggccctccttcaacacttagccaggctttcactgagcttaggaatcagctgtgatgaaacctgaagtttttaatcatgtcttttctgagcaagcatcttgccctgggcacatgcatggctggctaaattccctgcattcacaggtgcttctgattgtcctaacttcccaaagaaactctgttctcaaattttttgcccaagccttaggtggtttattgcatgtctcaactgtgaccttttgcctcaggccttgttcttctaccttatgatgattcaagcaatgcctgctgcttttccaatctgggttagttcagagttaggcaaacagaggtgagcattttgtgccagtccttcacgtacagacaggttaaaaccgatctacacaataatttgcaaataaggtctgctttgctccctctagaaccagggaccccactcccatgccgacagtatgggctgctgtcttcaggaccattgcaaggtaaggtgtggaataacagcaaataaaaatgccacaaaactttcctaccattt

SEQ ID NO: 422268 - DNA, 5049 bp, Homo sapiens
agttcagagttaggcaaacagaggtgagcattttgtgccagtccttcacgtacagacaggttaaaaccgatctacacaataatttgcaaataaggtctgctttgctccctctagaaccagggaccccactcccatgccgacagtatgggctgctgtcttcaggaccattgcaagcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422269 - DNA, 3081 bp, Homo sapiens
ctgggatttgcaagcctcttcacagggtagcacagcctggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422270 - DNA, 2064 bp, Homo sapiens
agcggggaacaatcacttgtgaaaaaagtattaaagcaaagagccactcagtctggcgacgccgccgccaagtgattgttccccgctagcggggaacaatcacttcatcagaaaaaaaaaattgtcagtgatatgtgaatgaaatgacatttctattttttctgatgaagtgatagataatacaatctaaagtgactttagcaatgtgcttgacttttacttctctctctcaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 422271 - DNA, 4041 bp, Homo sapiens
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtaactgaatcaaaccactaggttttatcaatgcttcatagagtttacactgttttaataggccctttctggctatattaatgtgtctcattcctctggcctgactcaaggttagagaaggtttagaacatttggaattgattgatatttatcttcaagaaacacacctttcagcctgtttcattgaaagcagcctatataaatgactgagcttcatatgacaccgtcttccaaggaatgaaagaaatctaaccaccagctcaacattcctagcttcccaggagagggcattcatctgatgcagttcttaaaactgtgagcaggtggagagaatctagttcctttcttaaacacattcctgcagagggaggctgtaggacagagtgggcattgcagattcagggaactcctggacagagcagagcaaaacctacgggagacctggctgtctcatgaatcaccagaggttcccaggttagaaggccacacactggctacaaccatgtctcagccaggaacactgtccaggggagaggctgcttacatctctaccgcaccctgccacgtaaccacataacgacataaccaatcagcactcccctaggtgcatcctacatggacacaa

SEQ ID NO: 422272 - DNA, 2031 bp, Homo sapiens
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgaggttcgtctccctgtgccagagccaggctgtatcccatcagtaatgtgctgagacccagatcgaccaaaacacgctgactgacttaaacaaagtggaccctccccaca

SEQ ID NO: 422273 - DNA, 1200 bp, Homo sapiens
cgcggcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcaggtaggaagtttgggcccaggagaagctggagtttgtgggatgggagaggcattgtagagctcagaccccctgctgcagctgaacttggtggtgctagagtgctttaaggcctgttctgggtaagttcttgccacacctggacttgccccaagtgaggagaaaaaaggcagcatttcagctttccaagaggctggttatccagcttgtgggctttggggcttcctttctttcctattcctttccttttccccacctcctaccattttatttttcatccgtattaatagccttatgtgcagaggtcagagggaagctctgcttgttagaagatgtaattcaacagggctgaagaaggcacttctcagcagccgtagtaatgtctggggaggaaggagatggccactctgtcactggtggtaggatagaaagattagacgctag

SEQ ID NO: 422274 - DNA, 902 bp, Homo sapiens
  misc_feature (835)..(835): n is a, c, g, or t
  misc_feature (838)..(839): n is a, c, g, or t
  misc_feature (846)..(847): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccggcggagagngannagaagannaaaagagagaaaacaaaacaaaaaacaaaaccaaaaagaaaaagacgaaccaagc

SEQ ID NO: 422275 - DNA, 1120 bp, Homo sapiens
  misc_feature (18)..(18): n is a, c, g, or t
ggtacaccgggtgccgcnagaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctacggggccagacgaagagcgaagcgacgggacggcagagacaaggagaaccgcagcacacaacgacagagaagacccaagcacaaccacgcacacaacaacaccaacacaacacaaaacacacagcacaagccacagccaaactacaaacagacacggccacaacacaacacacaaacacacacgaccacacacgagacccgataaaacagaagaaaccagacgcaaaacacggaacgacagacggcacaacaaaccgagagcacagaggggaccgcacatcggcacagacacacacaagacacaccaacacgagccgacccaagcaggagaatacacacacacaacaccccaccccacacggcgcccagcccaccgaccgacctccccctcccaacaacgacgcacaccagagccacgaacgcgcccaccccacacgcaccacacacactcaccacccccacaactcacaccacaccgaggccacccactgtacaaaccaagaggcgaaaaacaaaacaggacaaacatacaaagcacacgacgacaacaaaccctccaatacgcgacacgcacaccaacaagacgccacaaacgaaaccccaacaccagccaacacggacaacccagacacccc

SEQ ID NO: 422276 - DNA, 1242 bp, Homo sapiens
  misc_feature (1154)..(1154): n is a, c, g, or t
  misc_feature (1156)..(1157): n is a, c, g, or t
  misc_feature (1167)..(1168): n is a, c, g, or t
  misc_feature (1170)..(1170): n is a, c, g, or t
  misc_feature (1175)..(1175): n is a, c, g, or t
  misc_feature (1184)..(1185): n is a, c, g, or t
  misc_feature (1188)..(1189): n is a, c, g, or t
  misc_feature (1200)..(1200): n is a, c, g, or t
  misc_feature (1207)..(1208): n is a, c, g, or t
  misc_feature (1211)..(1213): n is a, c, g, or t
  misc_feature (1220)..(1221): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422277 - DNA, 1696 bp, Homo sapiens
  misc_feature (1695)..(1695): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcaaaaaaaaaaaaaaaaaaaaaaaaaaaaaaaaaaaaaaaaaaaaaaaaaaaaaaaaaaaaaaaaaaaaaaggggggcggccgcgccccaaatatatattctctctctctcggagagggcgcccacatttttcgcgcgctcacacccgaattttgttgtggaaagagagaggggctccctctatataggggagagcgtcgtcttttattataagccgcgagaggagcgcgggcgcgccgcgcgtttttatacaacaacggttggtagaggtggggacaacagacgcgggaacaacgtggtgaggatcttcttgtgagagaaaaagagcacacctcttctatttgtgggcggggggaggagagaacaattctgtgtggcggcaaaaaactctcctctctctcgagagaatgatttattagaacgctctctctagagggggaatatctttatatacacactattttataagaggtgtgtatatatagaggtgtgtgtgtataaaaacaaaaaggggtgtgtatatatgtgttgtgtgtgcgagtggtgagagagagaaattgtgtgtggtgtatatgagtagggatttatttatattatttgtgatagagaaatattatttatatataacgcggaggggggattttttttttaaaaatattggnt

SEQ ID NO: 422278 - DNA, 1508 bp, Homo sapiens
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcaaaaaaaaaaaaaaaaaaaaaaaaaaaaaaaaaaaaaaaaaaaaaaaaaaaaaaaaaaaaaaaaaaaaaagggggggggcaaaaacccccgggggcgccaagccttgacgaccgatccccgggtttttttgggtaaacaaagggcgccctatataggggcgccttctattaataatgaccgacaggcagcgggcacgccgcatttcaaaacagcctgcgcggtggctggggaagacacgcatcgtctcggtagggacactttggtgggacacgaccccccacctctcgtggtgggtgcgaccactatatgtcggacacacccatcatccgtagtaaattatttaagccccttgaggattaaattataaaaactttgcacggttactattggggggtttaccaccagcccgatatgtatcccgggcgcgtgaaaaatttttgctcactgcacagttttttattttacaacaattt

SEQ ID NO: 422279 - DNA, 1195 bp, Homo sapiens
  misc_feature (1107)..(1107): n is a, c, g, or t
  misc_feature (1109)..(1110): n is a, c, g, or t
  misc_feature (1120)..(1121): n is a, c, g, or t
  misc_feature (1123)..(1123): n is a, c, g, or t
  misc_feature (1128)..(1128): n is a, c, g, or t
  misc_feature (1137)..(1138): n is a, c, g, or t
  misc_feature (1141)..(1142): n is a, c, g, or t
  misc_feature (1153)..(1153): n is a, c, g, or t
  misc_feature (1160)..(1161): n is a, c, g, or t
  misc_feature (1164)..(1166): n is a, c, g, or t
  misc_feature (1173)..(1174): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422280 - DNA, 1262 bp, Homo sapiens
  misc_feature (1174)..(1174): n is a, c, g, or t
  misc_feature (1176)..(1177): n is a, c, g, or t
  misc_feature (1187)..(1188): n is a, c, g, or t
  misc_feature (1190)..(1190): n is a, c, g, or t
  misc_feature (1195)..(1195): n is a, c, g, or t
  misc_feature (1204)..(1205): n is a, c, g, or t
  misc_feature (1208)..(1209): n is a, c, g, or t
  misc_feature (1220)..(1220): n is a, c, g, or t
  misc_feature (1227)..(1228): n is a, c, g, or t
  misc_feature (1231)..(1233): n is a, c, g, or t
  misc_feature (1240)..(1241): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgcttggctgcttggagtttatttagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422281 - DNA, 1660 bp, Homo sapiens
  misc_feature (1659)..(1659): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcaaaaaaaaaaaaaaaaaaaaaaaaaaaaaaaaaaaaaaaaaaaaaaaaaaaaaaaaaaaaaaaaaaaaaaggggggcggccgcgccccaaatatatattctctctctctcggagagggcgcccacatttttcgcgcgctcacacccgaattttgttgtggaaagagagaggggctccctctatataggggagagcgtcgtcttttattataagccgcgagaggagcgcgggcgcgccgcgcgtttttatacaacaacggttggtagaggtggggacaacagacgcgggaacaacgtggtgaggatcttcttgtgagagaaaaagagcacacctcttctatttgtgggcggggggaggagagaacaattctgtgtggcggcaaaaaactctcctctctctcgagagaatgatttattagaacgctctctctagagggggaatatctttatatacacactattttataagaggtgtgtatatatagaggtgtgtgtgtataaaaacaaaaaggggtgtgtatatatgtgttgtgtgtgcgagtggtgagagagagaaattgtgtgtggtgtatatgagtagggatttatttatattatttgtgatagagaaatattatttatatataacgcggaggggggattttttttttaaaaatattggnt

SEQ ID NO: 422282 - DNA, 1190 bp, Homo sapiens
  misc_feature (1102)..(1102): n is a, c, g, or t
  misc_feature (1104)..(1105): n is a, c, g, or t
  misc_feature (1115)..(1116): n is a, c, g, or t
  misc_feature (1118)..(1118): n is a, c, g, or t
  misc_feature (1123)..(1123): n is a, c, g, or t
  misc_feature (1132)..(1133): n is a, c, g, or t
  misc_feature (1136)..(1137): n is a, c, g, or t
  misc_feature (1148)..(1148): n is a, c, g, or t
  misc_feature (1155)..(1156): n is a, c, g, or t
  misc_feature (1159)..(1161): n is a, c, g, or t
  misc_feature (1168)..(1169): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422283 - DNA, 1008 bp, Homo sapiens
  misc_feature (920)..(920): n is a, c, g, or t
  misc_feature (922)..(923): n is a, c, g, or t
  misc_feature (933)..(934): n is a, c, g, or t
  misc_feature (936)..(936): n is a, c, g, or t
  misc_feature (941)..(941): n is a, c, g, or t
  misc_feature (950)..(951): n is a, c, g, or t
  misc_feature (954)..(955): n is a, c, g, or t
  misc_feature (966)..(966): n is a, c, g, or t
  misc_feature (973)..(974): n is a, c, g, or t
  misc_feature (977)..(979): n is a, c, g, or t
  misc_feature (986)..(987): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctaaaaaaaaaaaaaaaaaaaaaaaaaaaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422284 - DNA, 1025 bp, Homo sapiens
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctcttccctttttaggtcttgttttccaaactgattttaggtgatagtttcccctctagtcttggctcatttaagaagcacaaacattcaaattaaaaatacaataaattattcattctaaccttagcaaaggtacatggattctgtctaccaaatattaattttacagtgaccacaaaaggttatttggttggcgtccgtagcgg

SEQ ID NO: 422285 - DNA, 1002 bp, Homo sapiens
  misc_feature (32)..(32): n is a, c, g, or t
  misc_feature (35)..(35): n is a, c, g, or t
  misc_feature (914)..(914): n is a, c, g, or t
  misc_feature (916)..(917): n is a, c, g, or t
  misc_feature (927)..(928): n is a, c, g, or t
  misc_feature (930)..(930): n is a, c, g, or t
  misc_feature (935)..(935): n is a, c, g, or t
  misc_feature (944)..(945): n is a, c, g, or t
  misc_feature (948)..(949): n is a, c, g, or t
  misc_feature (960)..(960): n is a, c, g, or t
  misc_feature (967)..(968): n is a, c, g, or t
  misc_feature (971)..(973): n is a, c, g, or t
  misc_feature (980)..(981): n is a, c, g, or t
aaaactaggctaggtacgaggcctgggtggtnacnggtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422286 - DNA, 1420 bp, Homo sapiens
  misc_feature (32)..(32): n is a, c, g, or t
  misc_feature (35)..(35): n is a, c, g, or t
  misc_feature (1419)..(1419): n is a, c, g, or t
aaaactaggctaggtacgaggcctgggtggtnacnggtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcaaaaaaaaaaaaaaaaaaaaaaaaaaaaaaaaaaaaaaaaaaaaaaaaaaaaaaaaaaaaaaaaaaaaaaggggggcggccgcgccccaaatatatattctctctctctcggagagggcgcccacatttttcgcgcgctcacacccgaattttgttgtggaaagagagaggggctccctctatataggggagagcgtcgtcttttattataagccgcgagaggagcgcgggcgcgccgcgcgtttttatacaacaacggttggtagaggtggggacaacagacgcgggaacaacgtggtgaggatcttcttgtgagagaaaaagagcacacctcttctatttgtgggcggggggaggagagaacaattctgtgtggcggcaaaaaactctcctctctctcgagagaatgatttattagaacgctctctctagagggggaatatctttatatacacactattttataagaggtgtgtatatatagaggtgtgtgtgtataaaaacaaaaaggggtgtgtatatatgtgttgtgtgtgcgagtggtgagagagagaaattgtgtgtggtgtatatgagtagggatttatttatattatttgtgatagagaaatattatttatatataacgcggaggggggattttttttttaaaaatattggnt

SEQ ID NO: 422287 - DNA, 903 bp, Homo sapiens
  misc_feature (18)..(18): n is a, c, g, or t
  misc_feature (815)..(815): n is a, c, g, or t
  misc_feature (817)..(818): n is a, c, g, or t
  misc_feature (828)..(829): n is a, c, g, or t
  misc_feature (831)..(831): n is a, c, g, or t
  misc_feature (836)..(836): n is a, c, g, or t
  misc_feature (845)..(846): n is a, c, g, or t
  misc_feature (849)..(850): n is a, c, g, or t
  misc_feature (861)..(861): n is a, c, g, or t
  misc_feature (868)..(869): n is a, c, g, or t
  misc_feature (872)..(874): n is a, c, g, or t
  misc_feature (881)..(882): n is a, c, g, or t
ggtacaccgggtgccgcnagaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422288 - DNA, 1130 bp, Homo sapiens
  misc_feature (1042)..(1042): n is a, c, g, or t
  misc_feature (1044)..(1045): n is a, c, g, or t
  misc_feature (1055)..(1056): n is a, c, g, or t
  misc_feature (1058)..(1058): n is a, c, g, or t
  misc_feature (1063)..(1063): n is a, c, g, or t
  misc_feature (1072)..(1073): n is a, c, g, or t
  misc_feature (1076)..(1077): n is a, c, g, or t
  misc_feature (1088)..(1088): n is a, c, g, or t
  misc_feature (1095)..(1096): n is a, c, g, or t
  misc_feature (1099)..(1101): n is a, c, g, or t
  misc_feature (1108)..(1109): n is a, c, g, or t
ggcgggctcctctcgggtcgggcgggttgggacggcgcccaccaggttcccgacgtctgggccggggccccgcgcacaaagcgcctttgttccacccgctcggccggtttgggctggttggagccgcccgcgccccgcgcggcgaaggcggtgccgggagctggggagccccgcctcggtaaataacccagcgcggcggctccacccgctggggagcgcccttcatgacggaaggccgctgacccgaggggctcctccacccccatgcgcagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422289 - DNA, 1162 bp, Homo sapiens
  misc_feature (1074)..(1074): n is a, c, g, or t
  misc_feature (1076)..(1077): n is a, c, g, or t
  misc_feature (1087)..(1088): n is a, c, g, or t
  misc_feature (1090)..(1090): n is a, c, g, or t
  misc_feature (1095)..(1095): n is a, c, g, or t
  misc_feature (1104)..(1105): n is a, c, g, or t
  misc_feature (1108)..(1109): n is a, c, g, or t
  misc_feature (1120)..(1120): n is a, c, g, or t
  misc_feature (1127)..(1128): n is a, c, g, or t
  misc_feature (1131)..(1133): n is a, c, g, or t
  misc_feature (1140)..(1141): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccaggccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422290 - DNA, 1320 bp, Homo sapiens
  misc_feature (1232)..(1232): n is a, c, g, or t
  misc_feature (1234)..(1235): n is a, c, g, or t
  misc_feature (1245)..(1246): n is a, c, g, or t
  misc_feature (1248)..(1248): n is a, c, g, or t
  misc_feature (1253)..(1253): n is a, c, g, or t
  misc_feature (1262)..(1263): n is a, c, g, or t
  misc_feature (1266)..(1267): n is a, c, g, or t
  misc_feature (1278)..(1278): n is a, c, g, or t
  misc_feature (1285)..(1286): n is a, c, g, or t
  misc_feature (1289)..(1291): n is a, c, g, or t
  misc_feature (1298)..(1299): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtgagtgcaggatcgcccctttctccccccgctcctccaggagctggcagcatcaagaccccacttcgcttctctcaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422291 - DNA, 1205 bp, Homo sapiens
  misc_feature (1117)..(1117): n is a, c, g, or t
  misc_feature (1119)..(1120): n is a, c, g, or t
  misc_feature (1130)..(1131): n is a, c, g, or t
  misc_feature (1133)..(1133): n is a, c, g, or t
  misc_feature (1138)..(1138): n is a, c, g, or t
  misc_feature (1147)..(1148): n is a, c, g, or t
  misc_feature (1151)..(1152): n is a, c, g, or t
  misc_feature (1163)..(1163): n is a, c, g, or t
  misc_feature (1170)..(1171): n is a, c, g, or t
  misc_feature (1174)..(1176): n is a, c, g, or t
  misc_feature (1183)..(1184): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422292 - DNA, 1604 bp, Homo sapiens
  misc_feature (1603)..(1603): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcaaaaaaaaaaaaaaaaaaaaaaaaaaaaaaaaaaaaaaaaaaaaaaaaaaaaaaaaaaaaaaaaaaaaaaggggggcggccgcgccccaaatatatattctctctctctcggagagggcgcccacatttttcgcgcgctcacacccgaattttgttgtggaaagagagaggggctccctctatataggggagagcgtcgtcttttattataagccgcgagaggagcgcgggcgcgccgcgcgtttttatacaacaacggttggtagaggtggggacaacagacgcgggaacaacgtggtgaggatcttcttgtgagagaaaaagagcacacctcttctatttgtgggcggggggaggagagaacaattctgtgtggcggcaaaaaactctcctctctctcgagagaatgatttattagaacgctctctctagagggggaatatctttatatacacactattttataagaggtgtgtatatatagaggtgtgtgtgtataaaaacaaaaaggggtgtgtatatatgtgttgtgtgtgcgagtggtgagagagagaaattgtgtgtggtgtatatgagtagggatttatttatattatttgtgatagagaaatattatttatatataacgcggaggggggattttttttttaaaaatattggnt

SEQ ID NO: 422293 - DNA, 1043 bp, Homo sapiens
  misc_feature (955)..(955): n is a, c, g, or t
  misc_feature (957)..(958): n is a, c, g, or t
  misc_feature (968)..(969): n is a, c, g, or t
  misc_feature (971)..(971): n is a, c, g, or t
  misc_feature (976)..(976): n is a, c, g, or t
  misc_feature (985)..(986): n is a, c, g, or t
  misc_feature (989)..(990): n is a, c, g, or t
  misc_feature (1001)..(1001): n is a, c, g, or t
  misc_feature (1008)..(1009): n is a, c, g, or t
  misc_feature (1012)..(1014): n is a, c, g, or t
  misc_feature (1021)..(1022): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggccagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422294 - DNA, 667 bp, Homo sapiens
  misc_feature (579)..(579): n is a, c, g, or t
  misc_feature (581)..(582): n is a, c, g, or t
  misc_feature (592)..(593): n is a, c, g, or t
  misc_feature (595)..(595): n is a, c, g, or t
  misc_feature (600)..(600): n is a, c, g, or t
  misc_feature (609)..(610): n is a, c, g, or t
  misc_feature (613)..(614): n is a, c, g, or t
  misc_feature (625)..(625): n is a, c, g, or t
  misc_feature (632)..(633): n is a, c, g, or t
  misc_feature (636)..(638): n is a, c, g, or t
  misc_feature (645)..(646): n is a, c, g, or t
tgtataagtaaattttgttggaacttgattttatcttgttgtattacttgatatttttaaaattaattaaattttgttaatagtaaaaaagttgtctttttgttttattctataaaactattatattttatattatttataaaattttttattcaatatataaatttcttataaaatttatctttatttttatttttaaaattatatataataataaatattttttatagaaataatttaaattttctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422295 - DNA, 1440 bp, Homo sapiens
  misc_feature (1439)..(1439): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccacccccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcaaaaaaaaaaaaaaaaaaaaaaaaaaaaaaaaaaaaaaaaaaaaaaaaaaaaaaaaaaaaaaaaaaaaaaggggggcggccgcgccccaaatatatattctctctctctcggagagggcgcccacatttttcgcgcgctcacacccgaattttgttgtggaaagagagaggggctccctctatataggggagagcgtcgtcttttattataagccgcgagaggagcgcgggcgcgccgcgcgtttttatacaacaacggttggtagaggtggggacaacagacgcgggaacaacgtggtgaggatcttcttgtgagagaaaaagagcacacctcttctatttgtgggcggggggaggagagaacaattctgtgtggcggcaaaaaactctcctctctctcgagagaatgatttattagaacgctctctctagagggggaatatctttatatacacactattttataagaggtgtgtatatatagaggtgtgtgtgtataaaaacaaaaaggggtgtgtatatatgtgttgtgtgtgcgagtggtgagagagagaaattgtgtgtggtgtatatgagtagggatttatttatattatttgtgatagagaaatattatttatatataacgcggaggggggattttttttttaaaaatattggnt

SEQ ID NO: 422296 - DNA, 1284 bp, Homo sapiens
  misc_feature (1196)..(1196): n is a, c, g, or t
  misc_feature (1198)..(1199): n is a, c, g, or t
  misc_feature (1209)..(1210): n is a, c, g, or t
  misc_feature (1212)..(1212): n is a, c, g, or t
  misc_feature (1217)..(1217): n is a, c, g, or t
  misc_feature (1226)..(1227): n is a, c, g, or t
  misc_feature (1230)..(1231): n is a, c, g, or t
  misc_feature (1242)..(1242): n is a, c, g, or t
  misc_feature (1249)..(1250): n is a, c, g, or t
  misc_feature (1253)..(1255): n is a, c, g, or t
  misc_feature (1262)..(1263): n is a, c, g, or t
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccagcttcccccagggttgacccgggtctctttgtgtgtgggccccgttttctttcgcggaggatgctccctccttcgtggattggctcgcccgacggtttggtggtcccgctcgggaagatcgtctgcggtacctctccccacgaggctctcacagtggctgtgagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcacagtagccccgatggtgtgtgcctgagctgtgtggcccgaggttccaaaaaaaaaaaaaaaaaaaaaaaaaaaaaaaaaaaaaaaaaaaggggggtttttttaaaaggcccccgggggntnnaaattttggnntnggccnttttttaanncannaaaaaaatttnccccttnnttnnnttttttnngggggttttttttaccagaaa

SEQ ID NO: 422297 - DNA, 866 bp, Homo sapiens
cccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtcggacgcgtgggtcgaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaagccagtcctggcttgctcaggtctcatggcttgctcaggtctatagatagttgggtggttggtgtaaatgagtgaggcaggagacctgagcaagccagg

SEQ ID NO: 422298 - DNA, 901 bp, Homo sapiens
  misc_feature (900)..(900): n is a, c, g, or t
tgagtccgcgcagacctgaccctgcgtctcgcagctcggttgagcccgccgccgccttctcgggatgcgcggccggggtccgcgcagcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagcaaaaaaaaaaaaaaaaaaaaaaaaaaaaaaaaaaaaaaaaaaaaaaaaaaaaaaaaaaaaaaaaaaaaaaggggggcggccgcgccccaaatatatattctctctctctcggagagggcgcccacatttttcgcgcgctcacacccgaattttgttgtggaaagagagaggggctccctctatataggggagagcgtcgtcttttattataagccgcgagaggagcgcgggcgcgccgcgcgtttttatacaacaacggttggtagaggtggggacaacagacgcgggaacaacgtggtgaggatcttcttgtgagagaaaaagagcacacctcttctatttgtgggcggggggaggagagaacaattctgtgtggcggcaaaaaactctcctctctctcgagagaatgatttattagaacgctctctctagagggggaatatctttatatacacactattttataagaggtgtgtatatatagaggtgtgtgtgtataaaaacaaaaaggggtgtgtatatatgtgttgtgtgtgcgagtggtgagagagagaaattgtgtgtggtgtatatgagtagggatttatttatattatttgtgatagagaaatattatttatatataacgcggaggggggattttttttttaaaaatattggnt

SEQ ID NO: 422299 - DNA, 624 bp, Homo sapiens
aaataaattgttttatatgctggctgaatagctaacaaaatatttgtgttttgatcaaaattaaagcattcaaagaaacctctcccatctccaagaaagccattctggtttcttcaccatctttgagactaaaggccttgaaatattttctgggtatcctgcaagatttttcaagatatacaacctagttttcccaggtattaaggcaacagtctagttctgatgcagagagaaattttaatccagagcactcatgagtgacacatggtcccagaaatgggacagatatggttctgtaatgagacctataccaacaaacaggatgaaaagtttgtctcccacctgctgacatttcttcacttttcagacagcaccagttgcccttgaagcagaaaacagaggtgaaatgaaactagctctccagtatgtcccagagccagtccctggtatgtaatgactttctattcagatttatgtcctttccttatccctcccttctcacagtatttactatgcgttttcaaaggtgaggccctaaagaaacttatcaagttagtaacgtatagaccaaatgagtctattcacagttgtaaataagaaaattctttttttgttattgtggca

SEQ ID NO: 422300 - DNA, 2792 bp, Homo sapiens
tttaaccattctaactttgccttgggatattgaaaattctgaatcagtgaggtatctaaataatttatattttcaaaaaataatgtttattttataattctgagtgtaaaacactatcagaaaagtaatcctcatgctcactaaacaaacctactctaagacactcaacaaccagaacagttttattattgagttgtgtacaaaaatcttgactgtccagatgaaatagtttttcagcctgcagtgtgttagtgatatatctcaaggagatgaaccaataaagtacagactttgtggtctgaagctctgttgtgaaaaaataagctaaaccaattcacactgacagtataatttgattcaagtgcagctccagttcaataaaaactaatgtttttaaaattaactttgttttgtatttggttcaactccttgctagttctctctctatataatttataaaaactgcatgttgctaatctcatgatcctgtgcatgtggactactctgcctttaacttttttacaaaaacatgtttgttcatagattaaataaaagtatgttttcaacttaatgtctaatgttttctgacaattgtaagaataattttgaaatggaaatgctgctgtttagtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422301 - DNA, 4276 bp, Homo sapiens
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422302 - DNA, 857 bp, Homo sapiens
ggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgaggtggcagtgtgaatgacgtgtgtatagggggacttgggcaatctggacgttccggacatattcaggtggcactggaccttgggggtcctgggaggggttggctgtgtttggggccaggtgagggcctagcgccggggtggtcaaaaccgcgtcgaccctatgttaggcgccttgtgcccccaggggcgggggaaccccgcgtgggaactgtttccggttctccacgg

SEQ ID NO: 422303 - DNA, 4348 bp, Homo sapiens
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422304 - DNA, 2308 bp, Homo sapiens
ggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422305 - DNA, 2406 bp, Homo sapiens
ggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422306 - DNA, 2285 bp, Homo sapiens
ggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaaatcaagcaaaagtagataatcagccagaagaattagtgcgtagtgctgaagatgagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422307 - DNA, 1907 bp, Homo sapiens
agccttggtttgcttttccagagtggggaagcaaatcagcttttatgaaagatggattttagctctttgaaacaagatgcttagaataagatgactttgcaatatttttgggactcgaaacctaacagataagaaaatttgctatatacagatgaatttctcttcatctctgtgttataactttggcatcaagtaatgtttttcatcatttaattttcttctttgaacttcagtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422308 - DNA, 3925 bp, Homo sapiens
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgaga

SEQ ID NO: 422309 - DNA, 1870 bp, Homo sapiens
aaataaattgttttatatgctggctgaatagctaacaaaatatttgtgttttgatcaaaattaaagcattcaaagaaacctctcccatctccaagaaagccattctggtttcttcaccatctttgagactaaaggccttgaaatattttctgggtatcctgcaagatttttcaagatatacaacctagttttcccaggtattaaggcaacagtctagttctgatgcagagagaaattttaatccagagcactcatgagtgacacatggtcccagaaatgggacagatatggttctgtaatgagacctataccaacaaacaggatgaaaagtttgtctcccacctgctgacatttcttcacttttcagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422310 - DNA, 1607 bp, Homo sapiens
aagaagcaagtgtccgtaaggttgagtaactttccctaaaatgcatacccaggaggtagcagagtcaggattcaaaccaagtatagctgactctaggtccagagtcttttcagcatgatgtgttcctaccccctaccccactgtctgccaaaccaccaccaccactatctctccacatcttttcctccattgtcaatctttaatagctgtgttgttatgtattgaaagcatgaatgttcactatcttactaaaatgctcccacaatcatgcctctttttgtagtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422311 - DNA, 1821 bp, Homo sapiens
  misc_feature (1792)..(1792): n is a, c, g, or t
  misc_feature (1818)..(1818): n is a, c, g, or t
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaaggccctgtgggtttgttagggattaaagncctgtggattcttcaaggaaaaaaanaaa

SEQ ID NO: 422312 - DNA, 2725 bp, Homo sapiens
tttaaccattctaactttgccttgggatattgaaaattctgaatcagtgaggtatctaaataatttatattttcaaaaaataatgtttattttataattctgagtgtaaaacactatcagaaaagtaatcctcatgctcactaaacaaacctactctaagacactcaacaaccagaacagttttattattgagttgtgtacaaaaatcttgactgtccagatgaaatagtttttcagcctgcagtgtgttagtgatatatctcaaggagatgaaccaataaagtacagactttgtggtctgaagctctgttgtgaaaaaataagctaaaccaattcacactgacagtataatttgattcaagtgcagctccagttcaataaaaactaatgtttttaaaattaactttgttttgtatttggttcaactccttgctagttctctctctatataatttataaaaactgcatgttgctaatctcatgatcctgtgcatgtggactactctgcctttaacttttttacaaaaacatgtttgttcatagattaaataaaagtatgttttcaacttaatgtctaatgttttctgacaattgtaagaataattttgaaatggaaatgctgctgtttagtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgattta

SEQ ID NO: 422313 - DNA, 2348 bp, Homo sapiens
ctcaagtctcagcatttagatctctctgggcacaactggtaaaatcttaaattcaaaggaaagagtcccagaacaagggtgggaaatcgtgcctctgcttatataaataactaaatatagacagagggtgaagttgattctgaatataatggagccagaagatcttgaagcttgtcagtggatcagtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422314 - DNA, 2454 bp, Homo sapiens
ggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422315 - DNA, 2567 bp, Homo sapiens
ggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccgtggagtttcactgttgttgcccaggctggcacgatctcagctcacagcaaccttcgcctcccgggttcaagcgattctcctgcctcagcctcctgactagctggaattacagatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422316 - DNA, 4294 bp, Homo sapiens
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422317 - DNA, 4401 bp, Homo sapiens
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatggtaatagtattgatgactctgtctgcaacagttctgtagcctggtctttgctgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatcta

SEQ ID NO: 422318 - DNA, 2286 bp, Homo sapiens
  misc_feature (2228)..(2228): n is a, c, g, or t
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctggtaagagagttgtcactactagattataaaaacttggtggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagcngagattgcgccactgcagtccgcagtccggcctgggcgacagagcgagactccgtctc

SEQ ID NO: 422319 - DNA, 905 bp, Homo sapiens
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcaggaatacagcatccttctgagagcctcttctcgacactatcccacagaccaggacttcctcatgggaaagagcacttaggat

SEQ ID NO: 422320 - DNA, 475 bp, Homo sapiens
aatggataaaaggtggtatgtacatacactgtagtattattcagccttaaaaaaggaaatgctgacacatactacaacatagataaaatctgtaaacattatgctaaatgaaataagccagacaaaaaaggaaaaatattgtatgattccacttatacacagtacctagaaatggcaaatttacagaaacagaaagtagaatggagattaccataggctggagggacagggaataaaagagttactgtttaatggatacagagtttgtttgagacagatgatatagtgcaaacagatactggtgaaaacacaaaattgtgaatgtgctttaacaccaccaaattgtactcaggaacagttaaaacggaggcggatgcagtggcatgcacctgtaatcccagctactcaggaaagtgaagtgggaggatcgcctgagcccaggaatttcagagcagcttggacaaccccatttcaa

SEQ ID NO: 422321 - DNA, 4240 bp, Homo sapiens
ggacattctgcctctcagtttctccatctactaaagagctcagactgtgcacttctcactcccacagtacactttacacagctttgaccatcctccctgctgcttggattgcaaaggacagggtactcttccaaaagacagacaacctttctctctccaaacaggtagaatcctttccaggcctgttaacaccaggtcagagaccccagtagatcacagccttttgcatatcagccagcagttgtccttgtcctagagaaggaactaatagctatgacagacacaatccccaaggaaaccaatttccttctaaatggggcggaaatgaaaactgggagagggctactcctcgttgcttgtgtccatggaataggcaattcccacagaccctgtaaggaagtgctgcaggtggcctcaggatgtccacatccctgggtcctgctgtgccctggaaatccccatctccaggagtcccacatccacacatgtggcttttctccctgtcggccagaaaccatgctttcttagccacgcagcataccatgtagcccgtgctctagcagcagcaacactcctgcccgcctgtctgtgcatgcgtccgtggcacactcctgtcctgggcaggtttcctctgcacacttagcaggggtgccagtgtacctctcatcgtccaggtgaggccaaggacaattgcaagcttttcctctgtcctcttctcactccttagctcccctctcctctccattcagtggcagcagcctcacaccaagaaggaaaatcctggacccattacataattctccatagtgcaagcagtagctggggcgtaaggtcagaggtcatagtggggtcaggtggctgacacacactgtaacgacaaggtggttaaaattagaccacagagaggaaactggcagtcttgtggaaatgcagaagtttcctatgcaagtgagaggctggagatgcagggaggccactgtgcgtgctgcctgccaggctattactcatttcggctctgttctttaatgccttttagcccctgcttctgtatttctagccttcctcatcacatgtttgaatacacgcaatggaaccatgcttacctgccctgggccaagacaagcttcccttctccttcacggaggcaagcccaggaccaggcaccccaagctcaaggggctgaactttttctaagcccttctgggtagccgagaaccttctacatcaacctctcaggtgaaggtggtcaaagtacttagcttgagattccagcctataatggtaacagggccaatggtgagagaaagcagagaacactcctagaccgtgtaggaaagcggggttggctttttggtgaaggtggcagaggatgcagccacagagcacacagttgaccggtgtgtgccgcactttcctgggcagccagcctgcacagcggtgctcatttatttccactgtcttagagaacatgggtcatgcctgcttcatctgctctctgtggtacccagccgagcttccctgggctgtccgtctttactgtgagcctactgtgtgcacagcttgtccttacaattcttgccagtgacgtacgaaaacgatgagatttaggctttgccaccagaggggttgctgtccacatgagagagagaacacctgcacctgtaaaatgatcatcagtagtctccaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422322 - DNA, 2520 bp, Homo sapiens
agcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaaaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcctcccaaagtgctgggattacaggtgtgagccaccgcgcccggccgaagatcacattctttaacaaggacctgtccaacatgccctgcccacttctccagactttcttacagaatcaatcatctagccatgccagtctacaatgtaccacttttgagaacatcatatatgttgttccctttgcttaagacacaccaggacgtgactccctctcctctccaaaaccaactgtttcttcaaccctcacttttcaactcaaaggtcttttcctctgagaggatatctctggtgctgcttctgtatatttccacagcatcctagccttccccagtcatggcacttcataattgtctgtgttacccatagagcaaggattatctctgccttgttcacagcttgtgcactgtgctttgtacataaaatgtgcccagtaggtttttgttgaatgaataaatgtatgggtccatgtgtgaggaagtcttcaccatccctcttacgctgtgtcaacctgttgatttataagatgggtttgatggctgagcacggtatctcacgcctgtagtcccagcactttgggagcccgaggtgggcagatcactaggtcaggagatcgagactatcctggctaacacggtgaaaccctgcctctactaaatatacaaaaaattagccaggcatggtggcgggtgcctgtggtcccagctgctcggaaggctgaagcaggggaatggcgtgaacccaggaggcagagcttgcagtgagccaagatcgcgccactgcactccagcctgggcaacaggctc

SEQ ID NO: 422323 - DNA, 6328 bp, Homo sapiens
agcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaaaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422324 - DNA, 3455 bp, Homo sapiens
cctctctgaacccccctgacacgcctcccatgacaaacttagactgcgcagcgacaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422325 - DNA, 2423 bp, Homo sapiens
ggcctaaagtttgactttgtgagtgtgtaccaggaagaacacagagtgaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422326 - DNA, 1528 bp, Homo sapiens
tcagtcggtaccgatttagctcctagacgggggggactgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422327 - DNA, 1461 bp, Homo sapiens
gatagctgattctagaggatccttaagtcaggagcgaactgcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422328 - DNA, 5770 bp, Homo sapiens
agcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaaaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggcctcaccatagagggggtttgtgggtgagagggggttctgtgcgtaggggatcctaagagc

SEQ ID NO: 422329 - DNA, 3909 bp, Homo sapiens
agcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaaaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggtcagccccaggccaaacatccctccccattcgcccctcctcttaattctccagacttttttattcttgggaagttttctgtgcaaatggaacatgattaagtcattgagaagggtgttaagggaaaatatcga

SEQ ID NO: 422330 - DNA, 3376 bp, Homo sapiens
agcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaaaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagctcctccaggaagttctatgtatttgaaagtccatcggtttgactgaggttggaatttggtagtcaagcatggtgatccttctcaagta

SEQ ID NO: 422331 - DNA, 375 bp, Homo sapiens
aatttgcaagttaatttcaagtctccagccacgtcaggaaagtaagaaagattctaagtgtctcacctctcctgcgttaggcaatagagttgtgtagaatggtagctgtgataggtgccttctctaggtttgcggccagtctgtgaaattggtttttgttgattaacataattggattattaaggctattttctcccgctgctctagaaagtagtaggaatagctttccccatccccccgccccccaccaagttacagactgccgagggtgagctattcttgggttaaactgctttatctttgtggatacttcatgaacctaccttttaaacttatgaaaatagtgaagcactatccaaaacctcagtctctttt

SEQ ID NO: 422332 - DNA, 302 bp, Homo sapiens
ggcattctatttccactggcctgaaaacatacagaccccgatgagcagagccttgtgagagggaggaggacggcaacacacgaagaactgagacagatgactgggggcttctaggtctaggcattcttcaaggggaaatttgggatcgttaggcggaacagtcagtgtgatagtacctcagaagacaatagcagaactatgtctggttacctaaagtaaacgcttgggtaaaatatctttaggccgagtgcagtggctcatgcctgtaatcccagcactttgggaggccgaggcaggtggat

SEQ ID NO: 422333 - DNA, 6002 bp, Homo sapiens
gcggccgctcgcgatctagaactagcggacgcgtgggcctggctgcgcgcggcggtggcggagccgctacggctgtagcagcagccgcgaagatggcggaagggctggagcgtgtgcggatctccgcgtcggagctgcgcgggatcctggctactctggccccgcaggccgggagcagagaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422334 - DNA, 5323 bp, Homo sapiens
acaggaatggtcaagagcaatcagtgggggaattgcaaagaggaaaaggctgcatggaatgactcgccaaagaataaacagggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422335 - DNA, 3263 bp, Homo sapiens
cgatgagcagagccttgtgagagggaggaggacggcaacacacgaagaactgagacagatgactgggggcttctaggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422336 - DNA, 2311 bp, Homo sapiens
cctcttaccgtgcgacccagagatcggaatgggacgtgacggccggcacaggcgccgtgcacagctgccaggaatctgacgggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422337 - DNA, 6217 bp, Homo sapiens
agcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaaaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422338 - DNA, 5215 bp, Homo sapiens
agcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaaaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 422339 - DNA, 802 bp, Homo sapiens
gccctttcccaggcggtagcgggggcggtggttctgttgtcctgttgcccttttaagctgcggcttgacaggggccgcgcctcctgtcggtggagtcggttacaaagggagcagccccccaggccgccacacagctcccgccaagacctggtgccccttgccattttccagccgcgctcccaggagagtggaggctgcaggaagaggcgggtctttaggctcacaagagctcggccaggcggccccgcggggtggtcgtggccatgacagcggctccagacggctccccttccacgcccttcccgccggagatgaggggaagatgtctgtgtcaagattcaaggccaaactgaagttgctggcgtctatcttccacgagaaccaggaggctcagctgcggctcacgctccactgcaacatgagaatgggacaacagaagaagtgacttcagaggaagaggaagaagaggagatggctgaagatagggtctcctgtcacccaggctggagtggagtggcatggtcacggtcactgcaaccttgaactcccaggttcaagcaatcctcctgagtagcttggaactacaggcgggtgccccacgtcggctaattttttcaattttctgtagaagttgaagtctcgcatctgttgcccaggctggtcttgaaactcctggctcaagtgattccacactcggctcccaaagtgcttgggattacatgcgtgcaccactgtgcctggctgtaggcttgtttataaagtctgggagtaaaatacttctttaaattggtccaatagcatg

SEQ ID NO: 422340 - DNA, 4602 bp, Homo sapiens
  misc_feature (1326)..(1326): n is a, c, g, or t
  misc_feature (1484)..(1484): n is a, c, g, or t
  misc_feature (1946)..(1946): n is a, c, g, or t
  misc_feature (2417)..(2417): n is a, c, g, or t
  misc_feature (4497)..(4497): n is a, c, g, or t
  misc_feature (4546)..(4546): n is a, c, g, or t
gccctttcccaggcggtagcgggggcggtggttctgttgtcctgttgcccttttaagctgcggcttgacaggggccgcgcctcctgtcggtggagtcggttacaaagggagcagccccccaggccgccacacagctcccgccaagacctggtgccccttgccattttccagccgcgctcccaggagagtggaggctgcaggaagaggcgggtctttaggctcacaagagctcggccaggcggccccgcggggtggtcgtggccatgacagcggctccagacggctccccttccacgcccttcccgccggagatgaggggaagatgtctgtgtcaagattcaaggccaaactgaagttgctggcgtctatcttccacgagaaccaggaggctcagctgcggctcacgctccactgcaacatgagaatgggacaacagaagaagtgacttcagaggaagaggaagaagaggagatggctgaaacatataggaggtccaggcagcatgaacagctccctggtcagagacacatggatttgctcactggttactcaaagctgattcaaagccgattaaagctgctgcttcatctggggtcccaacctccagtgggaaaaacattcttcttttcctgctggtgtcacccactgttccacggatccaaaacaacacccaatgtttggtacaaatttagtgaaacagctctttccattcttaactcatgccaagcatctcagcttggggtcaggaaaatgccaggggacatgagctcttctcctagagttagagaattctctgccttagttgcaataaaggaaaagatacacattcttcctacaaatgccaaagtaggctcaaaacttggttcctagagtagagtattgaagtcgtggcaaagatctttccagtgatcaaagcagtggctcgttatgttccctcagactgaagctacagtctcatcttcactttctgttagctccctccatcctctgcgtaggcccacacctgcttcttacagttgtgtggattatagcacctcctctccagcctcaggacctttgtgagtgctgctccttcttccttgactgctcttcaccagggatcctcagggcacagcccttacctcctgcaagtcttgacttaaatgtcactttctcagggaggcccacactcatcaccatttcacacccacctcccacatgaccttattttacctgttctctcttctcctcttttttttagagtacttatgatctcatgtggtacattttggggtttttggttcttctgtatccgccactgccatgatcagttagaatgttggaaancaaggaaacttggttttttggcctgtgatgaaaactatggggtctaatagtatctgataaagtggcagaccctcaattattatttgctgagtaaatgaatgaaggtgtgtagacaactagctctagaagcttaaatgagtgataccatgttttataanattggaagaggccgggaatggtggctcacgcctgtaatctcagcattttgggaggccaaggtggatggatctcttgaggtcaggagtttgagaccagcctggccaacatggtgaaaccttgtctctactaaaaatgcaaaaattagctggacgtggtggcacacgcctgtaatcccagctactctggaggctgaggcacagcatcacttgaacccaggaggcagaggttgcagtgagctgagatggtgccactgcactccagcctgggcaacagagtgagactctgtctccaaaaacagaaaaaagaaagggggggaagaaaagaagaaggaagaggaaagggaggaggaggatttatcattcacttacactagaaacagtgaaaatagataatagctataatttactcacatcttatctaaaacacaaattcagggtaatttatgagcaagtcattttccngtgggctttcgatagtgtgtgaatttggaatgaatgctggtacttccagctcccttccacctgcagcaccaggaagccattgttgtggggaggccaccaacttggctggcatgttgcttctgcctcagttagtgatgatggtgatttggagagaaaggacactctgctaggctccaaatccaaaggatcaagtggataaatgaaatgaatatctaaataaatatcaattaggtcaaaagtttgttttcatctaaatgaaatctgaacactacttagggctatgaaacatagccagaggacatggccagctctggagtggggcctggacttgctctcccctgctggaagtgcttttcctcccagagctcagagcaccatgtgcgtgtgacccctgccttttcacaggccattgccacagggcatctccctggtccacccgccccaagatgagccagcctcccactcaggaantgggtggggaagggaaagaaagacagaggagagagagacagtcacacacaggcagtggagctcccctgcacccaccagggagcttgagcagctcatctgcagagcagggaaacatttttactaccattgggaagacgctgagcagagaggtgaggggacagcatttcttgtctccctgtggcttgttccactcacagttcagtttctcctgttcttggggaaaaggagggaaactgtattagtcagggttctacagagaaacagacccaataagatgtgtgcatgtgtgtgtgtgtttatatatgttcacagaatgtatatatgtgtatatatatgtatatggataactgcatatatatattatttatagagagagagaagagcaggagacagagataaagagagattcatataaagaattatattcataatttatataataatttgttcctttaatcataaagtctggcaagtccaaaatctgcagggcaggccagaagcctgggcaccccggaaagagttgcatctagactctgaagacggtctggaggcagaattccctctttcccagggaattccagtctgttttctctgaaggcctttactgactagatgaggcccccacacacatggaaagcaatctgccctactgaaagtctactgacttagaggtttagctcatctaaaaaataccttcgtagcaatttcgagactggtatttgaccaaatagctgagtaggttggcctagccaatctgacacataaaattaactatcacagaaacaaaataatcaatataggtaataactgtgccagaatgctgtgatgtttcaggatgaccttgtttacatttacatttattgtcaaaacttaccttctctttttatatgggcaattaaatctgctactgagggtatcaagtactgatttaatttacaatcttaatagataagataggttcctattttctcctctccataaaagtaataagtttggagaaaccaggtcggaaatacctctccagattttaaagcataacctcttgtttggaataataagtatgtaaataagcaccataaaatatgaaaccaaacatttcatcattcttttatatacattatcccttgcatttttaaaaaataaggaacaccttattagccatattttcaaatggtgaaaccaacacccccagctcagactctgccgtggtaggctccagggtcactgataccagatcccatggtattttcactatatcccactctttctttgcatgtggctcttttttagctgcattgcgggtaaacaggtgtggctcttttcaaaccaattccatgcatatgtgaagaaaattgatcctgaagttccttttgccaaagatgcttatggagaagtgtctgtgtctggacagacaaaagtgtccatttttgcctcgaagcttggcaaaattgaaattgatgatggggaagctagaaatacttcagtctacatttcgaatcccagctgcggggaggctggttgaggattgcccatccctcagtctgggctggattctccctccagtctctggggttctcttttctattcacaagagggtgctaatgagatggtttaatctctataccctgtggtccacaaatacaagatgccagcgtggccaatggggcttccataagagtggcaatcaggggtctcaagcttaccatgacgttttgggccctggaatcagatcatagttctacagttgtcctggcactagaactcatgacaaggttgtgactagacagaaggagagaaggctggaggctgacaggaagcaatgtgaacaaatgccttcgcaggatgcatgggtttgggcaacagatggtcaggggaggtgctggtgcagacgggctcagtagcaaagcaataactgtggatggccattttatggctgcagatcacagcacatttataaaagatgtgtgtttcatgaaaatgtgcatttcatcgtggaaatactgtggttggaggagatttctcaaagctgataaataagtgtaggtgacttaacttgcaaaagatgatcatatgtgagaanggatgtctcaaattaggaaataacttgttaagtaaaaaagcctcatgtnttgatttgaagaaaaagatattttggtgctcatcaaaataaaagtataataagctg

SEQ ID NO: 422341 - DNA, 735 bp, Homo sapiens
agaggtgcccggtcgccccagcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgcttacacctttttgaactttatattcattgtcttacaattagtttaaaataaatgacatgattcaaaaaaaaatg

SEQ ID NO: 422342 - DNA, 680 bp, Homo sapiens
agaggtgcccggtcgccccagcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagtttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgcttacacctttttgaactttatattcattgtcttacaattagtttaaaataaatgacatgattcaaaaaaaaatg

SEQ ID NO: 422343 - DNA, 323 bp, Homo sapiens
aggggaatatactgatatccaaggactagaatggagtggtaactttcattttacagctgctccagacctgaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgctta

SEQ ID NO: 422344 - DNA, 664 bp, Homo sapiens
agaggtgcccggtcgccccagcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgctta

SEQ ID NO: 422345 - DNA, 1193 bp, Homo sapiens
agaggtgcccggtcgccccagcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagaataggtaagcttaaaataaaaaaaaatcactgcatttctaaaagattattttctggtatgtttgcttaaatacttatttatttatttatttattgagacagagtctccctctgtcatccaggcaggagtgcagtggagtgatctcggctcactgcaacctctgcctcccgggttcaagcgattctcttgcctcagccacccaagtagctgggtccacagatgtgcactaccacacccagctattttttgtattttcagtagggacggggtttcaccgtgttgagcaggctggtctagaactcctgacctcaagtgatctgcctgcctcggcctctcagagtgctgagattacaggcgtgagccactgtgcccagctgcttaaatactatatttagttaattctaaatattcttttatgatatagtttctaaaaattgttggaggccaggtgcggtggcacagcacctcaaacatcattgatagtgaaaaaatatttgttgaataagtgaagtaattaagctagataaccgatataaacttttcatttttttaactcattgttttggttttgtgtgaacctagattatgtgatcctaaaatcttggacaccaaataattgtttgtttttgtttggaatagtatgtggtttttttttttttttttttggtttgtttgtttttttggtaggatatgaaagcaggatgctgggtttaaaagcaaagcttgaaagtagaggatataatcttcagacatagtatatatt

SEQ ID NO: 422346 - DNA, 289 bp, Homo sapiens
gagagagagagagagagagaagagagaagagagagagagagagagagagagagagagacagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422347 - DNA, 2157 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422348 - DNA, 2184 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422349 - DNA, 2068 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422350 - DNA, 2125 bp, Homo sapiens
agggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422351 - DNA, 1766 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctt

SEQ ID NO: 422352 - DNA, 1562 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaggaagtggggacgaatagtttactcgtaaagcgggatcctcagagtcaac

SEQ ID NO: 422353 - DNA, 1089 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggttccatttttgaatgaactagtttaatgtggatccaaatttattgtgcatattctttcgttttggttttcaaaagatggcttattcacatggaaatgtacaccagtttagccctgggccctccctttaccttcatatgtgtaaaagcttacacaggtttcagaaaataaatggtttcattttctctaaaataactagtacaaaataaaacagatgtcagttgttgaaaaagcagta

SEQ ID NO: 422354 - DNA, 850 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccat

SEQ ID NO: 422355 - DNA, 1062 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggttccatttttgaatgaactagtttaatgtggatccaaatttattgtgcatattctttcgttttggttttcaaaagatggcttattcacatggaaatgtacaccagtttagccctgggccctccctttaccttcatatgtgtaaaagcttacacaggtttcagaaaataaatggtttcattttctctaaaataactagtacaaaataaaacagatgtcagttgttgaaaaagcagta

SEQ ID NO: 422356 - DNA, 635 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaagggaacaaagatgaagttaaccctcccacctgtctttccttatgaacacttgccttttccaactgttttctgccatggctaatcagaaaaagtttcttaaggaaatggtggca

SEQ ID NO: 422357 - DNA, 733 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggtgagtttcctgagaaagctgagtagctggccactactagcttggaacttgttgcagagcttagcagagcactcacctattgggaaggaaatgtagtcagagatattcaggtagcatggttgccttatttttgactgtttggaggatcactgcacaccttacgtactccagtttatccttaacaaaatatgtcagatataatggagctat

SEQ ID NO: 422358 - DNA, 761 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaa

SEQ ID NO: 422359 - DNA, 428 bp, Homo sapiens
  misc_feature (4)..(4): n is a, c, g, or t
  misc_feature (38)..(38): n is a, c, g, or t
  misc_feature (42)..(42): n is a, c, g, or t
  misc_feature (141)..(141): n is a, c, g, or t
  misc_feature (170)..(170): n is a, c, g, or t
ccanttcggcaaagaattcacccctgaggtgcaggctncccnggcagaagatgggtgactggagtggccagtgccctgtcctcccagatacccactgagctcactgcccatgatgcagagctttccaaggataggctttantcctgcaagcaatcaaataataaatctantctgctaagagatcacaaaaaagtcagcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422360 - DNA, 2277 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422361 - DNA, 2223 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtatagcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422362 - DNA, 1276 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaatggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 422363 - DNA, 877 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccat

SEQ ID NO: 422364 - DNA, 753 bp, Homo sapiens
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgagggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctca

SEQ ID NO: 422365 - DNA, 365 bp, Homo sapiens
tcagaatgttgtctcaaaaccaatagcattagcatggcccaggaccttgttagaaatgcaaattctcaagccccatcccagatctacttaaaaattaagagatctgaatttgaaccagccctctgagtctgggcttggcaaacactgagcctgagggtcaaaccctgcgtgctatttcccttttacaaataagctaaagggaatctaggccagatgtagtggctcatgcctgtaaccccaacactttgcagggccgaggcagaattgcttggggccaagaatttgagaccagcctgggcaacttagcaagaacttatctctacaaaaaatgaaaaaaaaattagctaggatgtggtggcatatgc

SEQ ID NO: 422366 - DNA, 525 bp, Homo sapiens
caaagtgttgggattacaggtgtgagccaccgcaccctgcctagaaactattttaatagaagcaaatagtgcctgaatggtgggcgtctgttagcgagatggtgaactggcagatggcgcctgtgtgtcaatgcccatggccaccgtcctgctttcagacaccagttctcttccaggtaaccttctggcattttggggtttgagataccatttcctaaaggtgaattatcacaaaatactagaaataaccacataagtgtttaaaattattgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacatt

SEQ ID NO: 422367 - DNA, 598 bp, Homo sapiens
catcaccaccaccgggttcaaacaaagcagcattctcctgtgtcttttcctcataagtaagaacaaggtagcacattcatttttccattagtgcatttcaattcttttcctgcaagttgcattgctattgcttttctgaattgcttgatgatgaactgtgaagctgatgcttagctgcttgtgaaacttttcttaaaggaactgggtctaagaagcacacatacattaccctcaacaacctcaggtatcaagaagaggaccacactgctaacatgggtaatcctataacctggcttttcttgtggaactttgtaatttctataaaataccgccagctttgcgtattccactgagccccaacttagatatcagacgctagtgagtcctgcctattcaggaagctacgtattattcagcataatactgcccttttttttgataactggctttcaaatgggataatctcaagagaggtttcattgtatcctcttagagcgtatggatttaaatagagcctttcaaaaaaatagatgaaaacctacatctctaatatatttcctacttgggccttttgagcatattctgggcacatagagag

SEQ ID NO: 422368 - DNA, 590 bp, Homo sapiens
ctgggattacaggtgcccgccaccgtatctggctaattttgtatttttggtagagacgaggtttcgccatgtttcccaggctgatctcgaactcctgacctcaagtgatccacccgtcctggactcccaaagtgctgagattacaggcatgagctactgtgcctgaccttgaagcttctttctgactgatagagatgaggaggggagaaaactgtcttctcacatcaccacaattgataaatgtatcctggcatcccgtctctgagatctggcccttctgatgttccccaccaactgggctcaccttatgttgtctgctagcttctgtttggctcactggggaatattgacaaactgggaagtgtcattcctacgtgacctgtttttctttctgtttctttttagctgagattggggattttgatgaagccttggacagagagcacttagcaaaaaataaatacatacctcagcaagacgcactagaggacaaaatcgtggcctggtcacagcatgcatccctggcatacacctttcctagataaaccctgctccgagtgatagctgttccccgatcaaagctgtgtacc

SEQ ID NO: 422369 - DNA, 5682 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422370 - DNA, 5432 bp, Homo sapiens
cactccagcctgggtgacagagtgagacgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422371 - DNA, 5361 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatgcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422372 - DNA, 5789 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatggagtcttgctcttgttgcccaggctggagtgcaatggcgtgatctcagctcaccgcaacctccacctcccaggttcaagcgattctcctgtctcgacttcccagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422373 - DNA, 5628 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaacccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422374 - DNA, 5313 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaaggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422375 - DNA, 4573 bp, Homo sapiens
aaggaaatgtacgtagacgaggcggtgtattcgtacgggggagctagcttagaggaggcttgtcatccagctcggcagatgcatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422376 - DNA, 3601 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctc

SEQ ID NO: 422377 - DNA, 2310 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaaggctggagtgcgatggcgcgatctcggctcactgcagcctccgcctcctaagttcagagccattctcc

SEQ ID NO: 422378 - DNA, 826 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatggagtcttgctcttgttgcccaggctggagtgcaatggcgtgatctcagctcaccgcaacctccacctcccaggttcaagcgattctcctgtctcgacttcccagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccagctagcaggggccaagatggatccaagtggagtgagctgtttggaaatatcaggatatggggaaaccagcgattttctaaatgagacaaacatgttagtgaatctgtgaagaaaaagaaagcaggagaatcagttgaacccgggaggtggaggttgcagtgagctgagatcacaccattgcactccagcctgggcaataagagcaaaact

SEQ ID NO: 422379 - DNA, 691 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccaatggtgtcctcatcctccttcctcaaagccaccggctcctcctggacgggttgggtactgagatgctccatgaagcccaagcaccattcacatctaattgagaagtttggagaggacagaattctcactcatcttacaggctctatttcttacacaaactgggctggaagtagaagcttagc

SEQ ID NO: 422380 - DNA, 487 bp, Homo sapiens
agattcccaactgataaagcgtacttcatagctaaggaagtgtctaccaccgagcgaacatatctgaaggatctcgaagttatcacttcggtatgtgcagtatttccccaaaagcattcgattacatgatttatctcagctaatactcagctatacggggaggctggagctaattaaatgttggattcgctgacttcagttgaaaggattgtggtcctagggtatagaaattaaatgctaatagtatatttaattgggaatatatgctataacatttttgataatgatgattttcaagtgcaaaagaaggaagttcctaaggcagagaaaattaaaattaaacattttaccatctgtgtgcaccagtccagaacatgtcgtgttttgcccattgccaagtataactgctgatttttgttcacgggagacctcggaggtgaacaggagattcattttatctttgataataaattgagccttgtccgca

SEQ ID NO: 422381 - DNA, 642 bp, Homo sapiens
ccaggaggtagctacagtgggcgataactgcaccactgaactccagtatgagtgacagagccagaccctgtctcaaaaaaaaaagaaaaagaaaaaaggaagggagagcttccactaagcaggatgggacacgtcccgccattctctgccatgtccatgaaaataggaggtagcgttctccccagcaaccagaggccacctcgctcctaactgctccaatggagcgggcagtgtcactgcagcaaggtacttccagctccacactgagtgagtgcccaggccagtgggtctccactgtacctcaggaacgcctgggtgctggctgttcccttgctcttctgctgaagtggcagattaccaaccaggcggcctgacttcaccttgtgtttctgtaagcgatgcccaccaaagtgtcaggagtccgtccaaacaaaaggttgactaactggcgttcccgtgttgcaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctg

SEQ ID NO: 422382 - DNA, 725 bp, Homo sapiens
tgcggccgccccaacatcagaatggtaacacaccttctgcagctcaaagtctctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggtaagcagcagtggcctcactatgcactgcgcggggagcagaaaggaggcatcggagggacttacatttgaaccttttgaagagagacccttgcaaagcaaaatgtcctctttccatccacctgggagacaactggaaaaacacaacagtgtcgttagttcagaatcattgtgttcggaggagataaagcaatcctctgacctcatattctgctttttctccttacggggtgattcgcttctttaccttttcccctaccatatcccacagaagatttgagattgcttattttattttttttaaatgtacataaatgaaaatggaaaattaaaaaaaaaattaggtaaatagtaataaagccagaaaggtagtgcattaaattatgctagaaattcccatgcaggta

SEQ ID NO: 422383 - DNA, 4897 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccaca

SEQ ID NO: 422384 - DNA, 5561 bp, Homo sapiens
gtgccggaagcccgtgcctgtggctccgggggaggggagggctcggtgggtccctgaagactgtcctccccgcgcgacgtcgcaggcgaagcagccccaggcaggacctcaaaaagcgacctgcagagtccgagcccctgaccgcccgcctgccgctcccggcttcgccgtgcacacgtctcccgctctccccgatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422385 - DNA, 5253 bp, Homo sapiens
ctgggattacaggtgcccgccaccgtatctggctaattttgtatttttggtagagacgaggtttcgccatgtttcccaggctgatctcgaactcctgacctcaagtgatccacccgtcctggactcccaaagtgctgagattacaggcatgagctactgtgcctgaccttgaagcttctttctgactgatagagatgaggaggggagaaaactgtcttctcacatcaccacaattgataaatgtatcctggcatcccgtctctgagatctggcccttctgatgttccccaccaactgggctcaccttatgttgtctgctagcttctgtttggctcactggggaatattgacaaactgggaagtgtcattcctacgtgacctgtttttctttctgtttctttttagctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422386 - DNA, 3997 bp, Homo sapiens
catcaccaccaccgggttcaaacaaagcagcattctcctgtgtcttttcctcataagtaagaacaaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgttgtttgtttgcaatacactcagtgcagccttaagcaaatgagatcattttcagatttcatttttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtgggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaaaaaaaaccaaaaaacaaaacaagaaaaacaaaaacgggtgggggtgggccgaaaaatttacccctcgttggggcgcgccaatgtatgcaccggccagggcaggacacgggccgaaagggggtcccaaaaacgggccggtgaacctgggtgggctggcacaggcggacacacccccgccgcacagaacaagaacacaacgtaagcaacgtacctgttcttacgctcttcgaacgacgacggcacaagataccaacagcaaatacaaagagagcaaaataacacaaccaacagacaaaacaagaaccacagacaacctacggaaccaacacgtaacagcgaagaagaaacgaaacaaccagagagacacaaacaacacagacacaagaacacaaactagaagaaccacaatgagcgaagcgagcagcgagggcacacgccaggggccgaacacaaggaacggccgagacagcgaaacaagaagggcaggaacagagcaacggaagacacataggagaacgcaagagagacgcaacaagaacgcaaacaagaccgagtagcaggaagacaacaagaaaagtggaaaaaggcgaaaaaaacgcgaaaagaaaaaaagagaaaaaacgccggaaaaaacacaaaaaacaacgcagaagacaaccaagaacaaacagtcaaagaacaaagaaacaagagcaacaaacagaaaacgaacaagaaacagaagaagcacaagaacacggagaaaaccagca

SEQ ID NO: 422387 - DNA, 3018 bp, Homo sapiens
acgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggtaagcagcagtggcctcactatgcactgcgcggggagcagaaaggaggcatcggagggacttacatttgaaccttttgaagagagacccttgcaaagcaaaatgtcctctttccatccacctgggagacaactggaaaaacacaacagtgtcgttagttcagaatcattgtgttcggaggagataaagcaatcctctgacctcatattctgctttttctccttacggggtgattcgcttctttaccttttcccctaccatatcccacagaagatttgagattgcttattttattttttttaaatgtacataaatgaaaatggaaaattaaaaaaaaaattaggtaaatagtaataaagccagaaaggtagtgcattaaattatgctagaaattcccatgcaggta

SEQ ID NO: 422388 - DNA, 409 bp, Homo sapiens
gcggcctgcccaaagtgtgtgtgtgtgtggcctttccttaatagttgagcttttagcatctgcttgttcacgtctgtgggctttggggtcagggtgccaggaggggcagactagacccctgtctgcgccgagtgcctgtgggccagcaactgaggcagggccgtccacctgtcaatcaccgttctttgggaggctccttgcagtgccctatacacacactagcttcacagaggaggggacagtccctggagagtagacattgccagaaattataacaccagtgagagtcaggttaactctcggttttagattgcaaacttttgtctttgtacctatgtcttaggaacattactcatacttttactagaagtgttttttaattagttgttcctggcttttcagccccttt

SEQ ID NO: 422389 - DNA, 1470 bp, Homo sapiens
ccggagcggggatcaccttaacttgactgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggaaaaaaaaaaaggta

SEQ ID NO: 422390 - DNA, 1509 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggaaaaaaaaaaaggta

SEQ ID NO: 422391 - DNA, 1406 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggaaaaaaaaaaaggta

SEQ ID NO: 422392 - DNA, 1312 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggaaaaaaaaaaaggta

SEQ ID NO: 422393 - DNA, 1178 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggaaaaaaaaaaaggta

SEQ ID NO: 422394 - DNA, 1378 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttccctccctccccactgctgctgagtctgtctgatgttttggttgtgtgaataaatataattcccctctggaaaaaaaaaaaggta

SEQ ID NO: 422395 - DNA, 511 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaacca

SEQ ID NO: 422396 - DNA, 868 bp, Homo sapiens
acacctaggctaggtacgaggccgcgggttaatcggccgagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggc

SEQ ID NO: 422397 - DNA, 922 bp, Homo sapiens
  misc_feature (802)..(802): n is a, c, g, or t
  misc_feature (849)..(849): n is a, c, g, or t
  misc_feature (873)..(874): n is a, c, g, or t
  misc_feature (912)..(912): n is a, c, g, or t
  misc_feature (921)..(921): n is a, c, g, or t
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctgtanccggtttgccttttccccaagggattcaagggattccaaaatggggnttcccccccaaatccatttaaagnnaaaaacccgacaaccctttcctaaagaattccccgggngggaaaaant

SEQ ID NO: 422398 - DNA, 972 bp, Homo sapiens
tattttcaccccctcacttcccgcaccccaccaaacacccccccccccttagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggcaaaaaaaaaatggctcttggctacggggactttgggcctcccttaggagggaataagacttctcatactctctcttggccttgtcggaaacgg

SEQ ID NO: 422399 - DNA, 1129 bp, Homo sapiens
actggaaccttgtaggatgtgctttgccgggtggtttggaagtactaatgcatagatgaagcgaatcaaaatgtcagaagttcttgacggtagtgttgtaataagattctaggttttagccttaaccttgtccaagctggagtggacaggcacctagaatactttgcaactcccttcatgagaaggtggatgagacaggattaagggagatgagctaagacggatcaggaccctactctgaacatgtaggacaaggattgatttcatatgaaaattgtgggtatgcaaggcattttgtatgcctgcactctaattttggaaaaatagtatttttttgaaattgggaatgttagggcaaacaaaaggaagtgttcattttattgtggttcataaactaagagaccttcatgcctgtagagattggggagactggaaagtttgagtgagtcaagagtgctagaatgatttccccatcaaaagggcatgaccccaggccccaagcttgtacagcagcatctgccccattatacctctggcactcaggcagtgatgcctcttggccctctggcaaagggagcacacttccgttagttttgtatttgtatggacttttatacctatgacgtttctggttctgttaatcttgtttttccgactgactgaaacttcatctctgttatcatttgtgtattttcttgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaacca

SEQ ID NO: 422400 - DNA, 460 bp, Homo sapiens
ggggtacgatatcgtcgacccacgcgtccggaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaacca

SEQ ID NO: 422401 - DNA, 728 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaaaaaaaaaacaaaaaaaaaaaaaaaaaaaaaaaaaaaaaagggggggggggctttggcccaagtcaattttagatctcagcaagcttatgcatggcggccgaatttcgagctactttgcccaatttccccctatggggggccgattaccaataactggccgcggtttacaacgttgggactgacccttgggttacccacttatccctttgggcc

SEQ ID NO: 422402 - DNA, 785 bp, Homo sapiens
  misc_feature (33)..(33): n is a, c, g, or t
ccaaccatcccttacccaaaaaaaaaaaccccnacctcgagatcacgggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggc

SEQ ID NO: 422403 - DNA, 818 bp, Homo sapiens
ggggtacgatatcgtcgacccacgcgtccggaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaaaaaaaaaacaaaaaaaaaaaaaaaaaaaaaaaaaaaaaagggggggggggaaaaaaatttccccgaggggggcccaaatttaggggtaccaggttttttggtacaagggggccccaaaaaggggggggaataaaaaggataggaaggggcagggttaaaaaacggtcgtgcgggaaaaagggtacttgggaacgttggtagagagacctatatttctggggggggacaaatattgggaccacaacctaagaaattaaaagcctaggggaaatttaacatttcagttgttgtgggtaccagttaattgtttgcggtggaaattggtaggattattgaatagagaatatatataga

SEQ ID NO: 422404 - DNA, 638 bp, Homo sapiens
acacctaggctaggtacgaggccgcgggttaatcggccgaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggc

SEQ ID NO: 422405 - DNA, 892 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagatccctttgtgtctcattgctgtacattgctgggataagcactatggctttcagctctatcagagtgaccctagtggaaattacgggggatggaaggcacatgcatgaaacataatagcgctgagctgtgtcactgttgaaacacgactataagaaggcacaaatgaccttgaagtccgcactggcttagctatcaacgtactacataagaccatggatgttagtaaactctctgctgaacaacggggaatttgcacccttacaacgagagatgcacgaccggaatcagagttctcacacaaacgaagggggcagtggtcaaacacgaggagagaagcaagctgggcaaacaaacacaacaacacaaactttgcgccccccccagaaatttaaaacgtgggccgcccggtaaacatggcactgtccaacacgtgcgctgggtccaaaaccgggcc

SEQ ID NO: 422406 - DNA, 332 bp, Homo sapiens
ctactactactaaattccggccgcgtcgaccatggctcctgtgtggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422407 - DNA, 876 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcacaaaaaaaaaaaaagaaaaaaaaaaattgggggcattttatatttgcgggggggggaaaaaagggggtatgggaagtgggcagtgggctcattagggggttcccgtggaccccaagttttttgggtccaagggggggagacttggcggggctcccaataaaaggggagggcggaattaaattgggaaaaggccgggtaaccttgatatgtttggaaaaagggagacgaagaacagcgcagacagcaccgcgccacaggaaacgcggacataacccaggtaccacagaacagagaggggcctcgaaagccaccataacacaggagcacaaaagaacaacattcgagagcataaacaacatggacgatacattaaatcgaaaaacagacgtacaccgaaaggaacgatatagtaagaagcgaccagagacaagcaagccagactaggagcagaagaaaggaagcaggcagctgaacgaacagacgaccaaacgagagctacggagagcaatcaacgcgagaggcgcttcgcacaagcaaaggaggacaa

SEQ ID NO: 422408 - DNA, 2109 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422409 - DNA, 2727 bp, Homo sapiens
actggaaccttgtaggatgtgctttgccgggtggtttggaagtactaatgcatagatgaagcgaatcaaaatgtcagaagttcttgacggtagtgttgtaataagattctaggttttagccttaaccttgtccaagctggagtggacaggcacctagaatactttgcaactcccttcatgagaaggtggatgagacaggattaagggagatgagctaagacggatcaggaccctactctgaacatgtaggacaaggattgatttcatatgaaaattgtgggtatgcaaggcattttgtatgcctgcactctaattttggaaaaatagtatttttttgaaattgggaatgttagggcaaacaaaaggaagtgttcattttattgtggttcataaactaagagaccttcatgcctgtagagattggggagactggaaagtttgagtgagtcaagagtgctagaatgatttccccatcaaaagggcatgaccccaggccccaagcttgtacagcagcatctgccccattatacctctggcactcaggcagtgatgcctcttggccctctggcaaagggagcacacttccgttagttttgtatttgtatggacttttatacctatgacgtttctggttctgttaatcttgtttttccgactgactgaaacttcatctctgttatcatttgtgtattttcttgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422410 - DNA, 2085 bp, Homo sapiens
  misc_feature (12)..(12): n is a, c, g, or t
  misc_feature (18)..(18): n is a, c, g, or t
  misc_feature (21)..(21): n is a, c, g, or t
  misc_feature (23)..(23): n is a, c, g, or t
  misc_feature (30)..(30): n is a, c, g, or t
ccaatgctagtngagccnggntnaatcggncgaggccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422411 - DNA, 2070 bp, Homo sapiens
ctactactactaaattccggccgcgtcgaccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422412 - DNA, 2381 bp, Homo sapiens
gctctgctagggctggtgtctctgaggagaaaacgaggctggttctgcaaatgttggaataagtgcagactggattccactgctgcttccagaatgttccaactgccacctccaggataaagaagcaagagtggatgacaccagacaggacaggagcaagcaggaagcaaagccccctattgatagagccaaaccgggatcagctggaaagcagaagtgtttgcagaggcccagcctgatcattatagagccaagaacagcagctggctttggagcttggtcaaccggcttgaggcctgagttgaaagctagacccatcagcacagtctcttctggtgattggacttttgctagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422413 - DNA, 2403 bp, Homo sapiens
ttaacttatattaactcatttaatctggagaacactcttaaaaagtagaaaatattaccccagaaagtggtggagctggtatacaaaaccgcgtaggtgctttgttaaggaatgatgcattagtttcccggtaggaggataaagaagcaagagtggatgacaccagacaggacaggagcaagcaggaagcaaagccccctattgatagagccaaaccgggatcagctggaaagcagaagtgtttgcagaggcccagcctgatcattatagagccaagaacagcagctggctttggagcttggtcaaccggcttgaggcctgagttgaaagctagacccatcagcacagtctcttctggtgattggacttttgctagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422414 - DNA, 2068 bp, Homo sapiens
acacctaggctaggtacgaggccgcgggttaatcggccgagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422415 - DNA, 2301 bp, Homo sapiens
gtggctagcgagcgagggctctgtgcgtctgcgtagttcgctcacctccctttctaactccgctgccgccatggctcctgtggttagtatggctccgcgtgaggcctcggctccaggggaggcacgtgggcctcgccgagcccggcatctacccaggctcgctggggacggcgccctgcagcgtcctgctggggtgggctggcaggtcggccggagcgggccagagcccctgccgatcccagcacgttgtaggcggaggaggccgcggcccgagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422416 - DNA, 2079 bp, Homo sapiens
tattttcaccccctcacttcccgcaccccaccaaacacccccccccccttagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422417 - DNA, 2551 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgtaaaaaaaaaaaaaaaaaacaaaaaaaaaaaaaaaaaaaaaaaaaaaaaaaaaaaaaaaaaaaaaaaaaaacaaaaaaaaaacaaaaaaaaaaaaaaaaaaaaaaaaaaaaaagggggggggggggggaaaatatctggggggagggcgaagatataaatgagtgaggacgagagtgttttaattggagagaagggggcacaaaagatggggggtaattaaaaaacagcagagggggggggggtggttaataaaccagagcaggtggaaggaaacagtagtgtggtggtagttttgtagagaagcgaccccacttggtgtgggggaggagaagtggggagcacacacactgagagagagttgctgggaggagaaaaaaaaagggtggtaggtggtaaccaacacgtgtcttttcgggagaagagtggtagagggatgtaaaaat

SEQ ID NO: 422418 - DNA, 2206 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgtaaaagacacacacagacgacacacacacttttgggcgctccgcccgcaaaggttcaaaacattgtggggccgggcccgggtaagaccgggcaaaggtc

SEQ ID NO: 422419 - DNA, 2187 bp, Homo sapiens
tgaactcgcgcactcgggtgatcctcccgcctcagcctcccagagtgctgaaattacaggcctgagcccacctgtgcctgcaccctgattggtccttgacaggtgtttttaatgtcccaagtctccgtaaatgtgggatggagcttctctcagaggctcttccccccaactcccaaccaagagtgtcgcgcgacaccaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422420 - DNA, 2055 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422421 - DNA, 1999 bp, Homo sapiens
gcggccgcctactactactactactgctcgaattcaagcttctaacgatgtacggggacatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422422 - DNA, 2052 bp, Homo sapiens
gtggctagcgagcgagggctctgtgcgtctgcgtagttcgctcacctccctttctaactccgctgccgccatggctcctgtgaaaaagcttgtggtgaaggggggcagaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422423 - DNA, 2034 bp, Homo sapiens
ggttcacgttatgcattttggttattaagagactgagaaactccatcatgttatcctaagtaatgtgtttttattataaatagaagatggaatcatggatgctgccaaaaatgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422424 - DNA, 1985 bp, Homo sapiens
  misc_feature (33)..(33): n is a, c, g, or t
ccaaccatcccttacccaaaaaaaaaaaccccnacctcgagatcacgggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422425 - DNA, 1297 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgttaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422426 - DNA, 1406 bp, Homo sapiens
acacctaggctaggtacgaggccgcgggttaatcggccgagagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422427 - DNA, 1342 bp, Homo sapiens
  misc_feature (1)..(1): n is a, c, g, or t
  misc_feature (25)..(27): n is a, c, g, or t
naaacattcggctaggtacgaggcnnngtggcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422428 - DNA, 1074 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggcaaaaaaaaaaaaaaggggggcttaaattcctgggggcaagttaggtccggttttgtaaagggccaaaggagggattaaaaggagggggttaagttgatggaaagggggtttggggacctctgggttggaccccgaaaacggaatagttgggagtgtggaggtaaa

SEQ ID NO: 422429 - DNA, 1307 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggcaaaaaaaaaaaaaaaaaaaaaaaaacaaaaaaaaaacaaaaaaaaaaaaaaaaaaaaaaaaaaaaaagggggggggggggggaaaatatctggggggagggcgaagatataaatgagtgaggacgagagtgttttaattggagagaagggggcacaaaagatggggggtaattaaaaaacagcagagggggggggggtggttaataaaccagagcaggtggaaggaaacagtagtgtggtggtagttttgtagagaagcgaccccacttggtgtgggggaggagaagtggggagcacacacactgagagagagttgctgggaggagaaaaaaaaagggtggtaggtggtaaccaacacgtgtcttttcgggagaagagtggtagagggatgtaaaaat

SEQ ID NO: 422430 - DNA, 1442 bp, Homo sapiens
  misc_feature (123)..(123): n is a, c, g, or t
  misc_feature (153)..(153): n is a, c, g, or t
  misc_feature (240)..(240): n is a, c, g, or t
  misc_feature (267)..(267): n is a, c, g, or t
  misc_feature (291)..(291): n is a, c, g, or t
  misc_feature (297)..(297): n is a, c, g, or t
  misc_feature (311)..(311): n is a, c, g, or t
  misc_feature (320)..(320): n is a, c, g, or t
  misc_feature (325)..(326): n is a, c, g, or t
gctaggacagcgggtgatcccagggacgttgttaaaaggacgtcagtgtatctgtgcttctcaatgatcaggatacatgctcctctcattaaagaaaacgcgacatcttctaagattctctgntgggaaaaatgactgtcaataaaatgcggngttttctgggcccattccgtcctttaaactttttcaatttttttttgggaattttaacaaaaaatttccttctttggaaccgcaccnagccaagttaatagtgctaggcttaantaccttacttcctattcccttagnagaagnaagaaaacttgtgnctccccttnccagnntgtttaggcctggcccaattaaacaggggggttttggggggaaatttcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422431 - DNA, 1102 bp, Homo sapiens
gtaaatggccatgtcaggctgtggatcggacgaggggatgatgtaaagtcagttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422432 - DNA, 783 bp, Homo sapiens
gctctgctagggctggtgtctctgaggagaaaacgaggctggttctgcaaatgttggaataagtgcagactggattccactgctgcttccagaatgttccaactgccacctccaggataaagaagcaagagtggatgacaccagacaggacaggagcaagcaggaagcaaagccccctattgatagagccaaaccgggatcagctggaaagcagaagtgtttgcagaggcccagcctgatcattatagagccaagaacagcagctggctttggagcttggtcaaccggcttgaggcctgagttgaaagctagacccatcagcacagtctcttctggtgattggacttttgctagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaacca

SEQ ID NO: 422433 - DNA, 995 bp, Homo sapiens
  misc_feature (523)..(523): n is a, c, g, or t
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaaaaaaaggnaagaaaacacaacaaaaaaaaaagaaaacaaaaactgtttggggccgcggcaccgggggcccccgagaaaaacgcttttataagaacacttgcggtgagtgggccggcgcgggccccaagatggtaggtatacgggcaaccagtggtgccaaaagcggcgtggtacccggggggggaaaccatcccgtgggggctaggaagcaaacatggggctgttcgggagtgtcctctatcacccactaatttaaaaaagacgcccgcccgggggggggagagccaaccccggagcagtgacgttttttctgcgagcccaactcttcccaccgaagatgagaggagcgatctaggagggcgtgcaaccaataagcgaggggggctatcatcttaacacacaggggtgggtcttaccaagaggagaagggctcgtatagtatgcataaattatacggcccccggcatcgggtgggagagc

SEQ ID NO: 422434 - DNA, 852 bp, Homo sapiens
gtggctagcgagcgagggctctgtgcgtctgcgtagttcgctcacctccctttctaactccgctgccgccatggctcctgtgaaaaagcttgtggtgaaggggggcagaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggc

SEQ ID NO: 422435 - DNA, 1574 bp, Homo sapiens
actggaaccttgtaggatgtgctttgccgggtggtttggaagtactaatgcatagatgaagcgaatcaaaatgtcagaagttcttgacggtagtgttgtaataagattctaggttttagccttaaccttgtccaagctggagtggacaggcacctagaatactttgcaactcccttcatgagaaggtggatgagacaggattaagggagatgagctaagacggatcaggaccctactctgaacatgtaggacaaggattgatttcatatgaaaattgtgggtatgcaaggcattttgtatgcctgcactctaattttggaaaaatagtatttttttgaaattgggaatgttagggcaaacaaaaggaagtgttcattttattgtggttcataaactaagagaccttcatgcctgtagagattggggagactggaaagtttgagtgagtcaagagtgctagaatgatttccccatcaaaagggcatgaccccaggccccaagcttgtacagcagcatctgccccattatacctctggcactcaggcagtgatgcctcttggccctctggcaaagggagcacacttccgttagttttgtatttgtatggacttttatacctatgacgtttctggttctgttaatcttgtttttccgactgactgaaacttcatctctgttatcatttgtgtattttcttgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaaaaaaaaaaaaaaaaaacaaaaaaaaaaaaaaaaaaaaaaaaaaaaaaaaaaaaaaaaaaaaaaaaaaacaaaaaaaaaacaaaaaaaaaaaaaaaaaaaaaaaaaaaaaagggggggggggggggaaaatatctggggggagggcgaagatataaatgagtgaggacgagagtgttttaattggagagaagggggcacaaaagatggggggtaattaaaaaacagcagagggggggggggtggttaataaaccagagcaggtggaaggaaacagtagtgtggtggtagttttgtagagaagcgaccccacttggtgtgggggaggagaagtggggagcacacacactgagagagagttgctgggaggagaaaaaaaaagggtggtaggtggtaaccaacacgtgtcttttcgggagaagagtggtagagggatgtaaaaat

SEQ ID NO: 422436 - DNA, 510 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaaaatgaaatttaatcctcgtcttcctcctcttcttcgtccgtcgacgcggccgcgaatttagtagtagtagt

SEQ ID NO: 422437 - DNA, 369 bp, Homo sapiens
  misc_feature (60)..(60): n is a, c, g, or t
  misc_feature (62)..(62): n is a, c, g, or t
ccaggtccgagatcaggcagaagcaggaagcagaagcagggcagaagcaggaagcaggangnggcagaagcaggaagcagtggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422438 - DNA, 988 bp, Homo sapiens
gtggctagcgagcgagggctctgtgcgtctgcgtagttcgctcacctccctttctaactccgctgccgccatggctcctgtggttagtatggctccgcgtgaggcctcggctccaggggaggcacgtgggcctcgccgagcccggcatctacccaggctcgctggggacggcgccctgcagcgtcctgctggggtgggctggcaggtcggccggagcgggccagagcccctgccgatcccagcacgttgtaggcggaggaggccgcggcccgaggctcgtgagggagatccgggaggtctcggaggcccggggccccagctaggggctagcggggagctggagcctggagactgcggtctgggccggccactggtcctcggaccccggccgggggcctgattacctgggtggagggcggggaagaagaacgggacctgctaccctggggagccgcgcattcggaagtccacggccaagactcggggacgaatccgcggaagggcggcttggtcggcgtgctttcggagaggaggcctgggtttgaggagctttttagcgtccccagaggaaatcagtttatcagggcgcactgtacagacccaaacgggtgttgcagtggtgtagggagaaggctctcattgcattctcctttagctatgctgggactgggctgtgcggcgccctcctcctaggttatttgagaaagttgtttttccgtgttcttcgtcccaagatcctacttttcctcttttgttgggactccctggttaacatttccggttcttctgctctttctgtctggttgggcttttgaatgccttttggtttaaaaccttgatggagaagtatcaagcccgttgtgggtaggtctcttgattgattgtgtgtgttcggaatagatcttaaagtacccctcttagattattactgcgaagagacgttgtaaaaaataaatcagtgatttttgtagtggccaaatgtttgaaa

SEQ ID NO: 422439 - DNA, 797 bp, Homo sapiens
ctatcccatctcctctccctcatacttatttttatcccacacgaaaataaccctagatctgcctgctgccaatttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggc

SEQ ID NO: 422440 - DNA, 394 bp, Homo sapiens
  misc_feature (38)..(40): n is a, c, g, or t
  misc_feature (57)..(57): n is a, c, g, or t
ggaaataataaattccataacatatttatagcgcaatnnnaaccttaagaggaccgnagctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaacca

SEQ ID NO: 422441 - DNA, 2891 bp, Homo sapiens
gtggctagcgagcgagggctctgtgcgtctgcgtagttcgctcacctccctttctaactccgctgccgccatggctcctgtggttagtatggctccgcgtgaggcctcggctccaggggaggcacgtgggcctcgccgagcccggcatctacccaggctcgctggggacggcgccctgcagcgtcctgctggggtgggctggcaggtcggccggagcgggccagagcccctgccgatcccagcacgttgtaggcggaggaggccgcggcccgaggctcgtgagggagatccgggaggtctcggaggcccggggccccagctaggggctagcggggagctggagcctggagactgcggtctgggccggccactggtcctcggaccccggccgggggcctgattacctgggtggagggcggggaagaagaacgggacctgctaccctggggagccgcgcattcggaagtccacggccaagactcggggacgaatccgcggaagggcggcttggtcggcgtgctttcggagaggaggcctgggtttgaggagctttttagcgtccccagaggaaatcagtttatcagggcgcactgtacagacccaaacgggtgttgcagtggtgtagggagaaggctctcattgcattctcctttagctatgctgggactgggctgtgcggcgccctcctcctaggttatttgagaaagttgtttttccgtgttcttcgtcccaagatcctacttttcctcttttgttgggactccctggttaacatttccggttcttctgctctttctgtctggttgggcttttgaatgccttttggtttaaaaccttgatggagaagtatcaagcccgttgtggaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422442 - DNA, 2062 bp, Homo sapiens
tgtgttatggtcttgagtgatcccggagatagtgaaggtgatggggggattaacaggatgcagtgtggaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422443 - DNA, 2040 bp, Homo sapiens
acactctggttggaacacctggtcgtatcaaagaccatctgcagagtggccgattgatctttctaaactgcgacatgttgtgcttgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422444 - DNA, 1976 bp, Homo sapiens
  misc_feature (20)..(20): n is a, c, g, or t
aatttattaatgcaggacgnaaaaaaaccttcagatcatgggtgctgccattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422445 - DNA, 1997 bp, Homo sapiens
ctatcccatctcctctccctcatacttatttttatcccacacgaaaataaccctagatctgcctgctgccaatttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422446 - DNA, 1018 bp, Homo sapiens
  misc_feature (862)..(862): n is a, c, g, or t
  misc_feature (869)..(869): n is a, c, g, or t
  misc_feature (875)..(876): n is a, c, g, or t
gtggctagcgagcgagggctctgtgcgtctgcgtagttcgctcacctccctttctaactccgctgccgccatggctcctgtgaaaaagcttgtggtgaaggggggcagaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggcaaaaaaaaanaatggcntcttgnnctagcgtggactttgagccctttccttaaggggggtaatgatgatctcctcattgatccctggctcggacttcgttggggaacgtgttaactacttaaagcgggatccgtgttccaaactggggtaccctgaaaactttggc

SEQ ID NO: 422447 - DNA, 807 bp, Homo sapiens
  misc_feature (38)..(40): n is a, c, g, or t
  misc_feature (57)..(57): n is a, c, g, or t
ggaaataataaattccataacatatttatagcgcaatnnnaaccttaagaggaccgnagctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaaaaaacaaaaagaagaaaaaaaaaaaacaaaaaaagaaaaaaaaaaaacaaaaaaaaaaaaaaaaaaaaaaaaaaaaaagggggggggggggggaaaatatctggggggagggcgaagatataaatgagtgaggacgagagtgttttaattggagagaagggggcacaaaagatggggggtaattaaaaaacagcagagggggggggggtggttaataaaccagagcaggtggaaggaaacagtagtgtggtggtagttttgtagagaagcgaccccacttggtgtgggggaggagaagtggggagcacacacactgagagagagttgctgggaggagaaaaaaaaagggtggtaggtggtaaccaacacgtgtcttttcgggagaagagtggtagagggatgtaaaaat

SEQ ID NO: 422448 - DNA, 1058 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaaaaaaaaaaaagaaaaaaaaaaattgggggcattttatatttgcgggggggggaaaaaagggggtatgggaagtgggcagtgggctcattagggggttcccgtggaccccaagttttttgggtccaagggggggagacttggcggggctcccaataaaaggggagggcggaattaaattgggaaaaggccgggtaaccttgatatgtttggaaaaagggagacgaagaacagcgcagacagcaccgcgccacaggaaacgcggacataacccaggtaccacagaacagagaggggcctcgaaagccaccataacacaggagcacaaaagaacaacattcgagagcataaacaacatggacgatacattaaatcgaaaaacagacgtacaccgaaaggaacgatatagtaagaagcgaccagagacaagcaagccagactaggagcagaagaaaggaagcaggcagctgaacgaacagacgaccaaacgagagctacggagagcaatcaacgcgagaggcgcttcgcacaagcaaaggaggacaa

SEQ ID NO: 422449 - DNA, 819 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggc

SEQ ID NO: 422450 - DNA, 1002 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggcaaaaaaaaaatggctcttggctacggggactttgggcctcccttaggagggaataagacttctcatactctctcttggccttgtcggaaacgg

SEQ ID NO: 422451 - DNA, 1969 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422452 - DNA, 2190 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaaaaaaaaaaaaaaaaaaaaaaaaaaaaaaaaaaaaaaaaaaaaaaaacaccaaagctcgaattaagaaccaaacaaccagaaagataaaacatgaccctagaaatggaaaattacatggctaacaccttttgccgccgtatgccaattccattgttgtcattgcacactttgcccctgggaccattggcattacccagctttgcctttaggc

SEQ ID NO: 422453 - DNA, 2090 bp, Homo sapiens
gaattctgatgtcgtacctaaggcttgtccatctttgttgttggaggtgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 422454 - DNA, 733 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaggttatgcttgccggccgaatttgggcttacttggccaattcgccctaaagggaggcgtttaaaataaatgggcgcggttttacaaagtggggatggggaaaaccttggggttcccaaattaaagggtttggagaataccccctttccaggtggggtaaaaaagggccgacccgacgcccttccaacaatgggcaccctaatggaatggtttgcgtttt

SEQ ID NO: 422455 - DNA, 956 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaaaaaaaaaaaaaaaaaacaaaaaaaaaaaaaaaaaaaaaaaaaaaaaaaaaaaaaaaaaaaaaaaaaaacaaaaaaaaaacaaaaaaaaaaaaaaaaaaaaaaaaaaaaaagggggggggggggggaaaatatctggggggagggcgaagatataaatgagtgaggacgagagtgttttaattggagagaagggggcacaaaagatggggggtaattaaaaaacagcagagggggggggggtggttaataaaccagagcaggtggaaggaaacagtagtgtggtggtagttttgtagagaagcgaccccacttggtgtgggggaggagaagtggggagcacacacactgagagagagttgctgggaggagaaaaaaaaagggtggtaggtggtaaccaacacgtgtcttttcgggagaagagtggtagagggatgtaaaaat

SEQ ID NO: 422456 - DNA, 909 bp, Homo sapiens
gtggctagcgagcgagggctctgtgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggc

SEQ ID NO: 422457 - DNA, 967 bp, Homo sapiens
gagccggggtgaatctggaggggccgggccgagcccgggggcgctttcgcacgcgaagcaaccgctagagcaggacctggtctcccaagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgctgtagctgtctttgcttcccttccggtggaggtgaccagtttgtaatgaacttctggatctccagtcagatactatggaggagagagtgatggagggctgaggagaggcctcaggttgttatttggttggggaggcacagagcagaggttcaggtctcagcaggtgtcagaggtgattacagcccttcccatccaccttgcagcaggggctttgtgcctttcatctttaactgggcacctgagatgggaaccaatggggaccatcccagacacatgggtttgtctgtccctgacttctgcctctgagattgtctttgttggtctttgtttaataaacgccccgaccttcctcatgattgca

SEQ ID NO: 422458 - DNA, 427 bp, Homo sapiens
ccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattctttt

SEQ ID NO: 422459 - DNA, 739 bp, Homo sapiens
tctgtttggacaagcggtgaaccctcagagactttatcttactcttatcctttaatacagtgaatctatataactatatccagagacagttccctttgttttaaattgttattgggccgggcatggcggctcacacctgtaaacccagcactttaggaggccaaggtgggcagatcatttgaggtcgggagttcgagagcagcctggccaacacagtgaaaccccatctctactaaaaatacaaaaattagctgggcatggtggcgggcacctgtagtcccagatacttgggaggctgaggcaagagaatcacttgaatccgggaggtcgaggttgcagtgagccaagatcgcaccactgcactccagcctgggtgacagagcaagacttggtctcaaaaataaatacataaattgttattaatatatagcagacaagtgtacacaaatgtacagctcattgagtttttacaaactgcacacacttgtgtaaccagcacccagatcaagaaactacttaccagggccaggcgctcctgcctataatcctaactctttgggaggccgaggtgggtggatcacttgaggtcagaagttcaagaccagcctggccaacatggtgaaaccccacctctactaaaaataaaaaaattagccaggtgtggtggcgcctacctgttgtctcagctactcaagaggctgaggcaagacaatcacttgaacccaggaggtggagcttg

SEQ ID NO: 422460 - DNA, 285 bp, Homo sapiens
tcctcccgcctcagcctcacaactagctgggactacaggcacataccaccatgcctggctaatttttgtatttttagtagagactgggtttcaccatgttgcctaggctggggtttaagttaaatttttttaaaaactaaagtgactggcactaagtgaacttgagattatcctcagcttcaagttcctaagataagggctttcttaagctttcagatacatgtatcctctagatgtagacaataatgtcccatttctaagtcttttcctttgcttctccttaag

SEQ ID NO: 422461 - DNA, 3640 bp, Homo sapiens
gattggcttcgagggccagaatcggcaaagggccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagcctcgggcgaggccgtccggccgcacccctcctgctcagctgcggtcgccatggccaatgacagctgcgggcccggcgagccgagctcgagcgagcgagaccggcagtactgcgagctgtgcgggaagatggagaacctgctgcgctgcagccgcagctccttctgctgcaaggagcgccagcgccaggactggaagaagcacaagctcgtgtgccagggcagcgagggcgccctcggccacggagggggccctcaccaggactccggccccgcgccgcccgctgcagcgccgccgtccagggaccgggccctggaggccaggaaggcagcgaggcgccgggacagcgcctccggggacgcagccaaggcaaaggccaagtccgcggccgaccccgcggcggccgcgtccccgcctcgcgcgtccccgggccggacaaaagccatggctgcttgttatccggtcaatggaacgggttatgtacgtcatgttgataatccaaatggagacggaagacgtgtgaaatgtattacattacgttaaagaacgggatgccaaggtaagtggaggtatacttcgaatttttctagaaggtaaagcctagtttgctgacattgaacccaaatttgatagactgctgtttttctggtctgaccatcgcaaccctcatgaagtacaaccagcatatgctacaaagtacgcaataactgtttggtatttgatgcagatgagagagcacgagctaaagtaaaatatctaacaggtgaaaaaggtgtgaggattgaactcaataaaccttcagattcagtcagtaaagacgtcttatagagcctttgatccagcaataccccacttcacctacaataattgttgacgctatttgttaatttgtgaatacgaataaatgggataaagaaaaatagacaaccagttcgcattttagtaaggaaacaaacaactttgtgtgttgcatcaaacagaagattctgactgctgtgactttgtaccgcatgatcaacttagaatctgtgattgcttacaggaagaagataagctactaatagaaaatgtttttacctctggatatgaaataagtgccctgtgtagaatttttttcattcttatattttgccagatctgttacgtagctgagttaatttcatctctacttttttaatatatgtcaagtttgaattggaataatttttctatgattaggtacaatttatcaaaactgaattgagaaaaaattacagtatttctcaaaataacgtcaatctatttttgtaaacctcttcatactattaaattttgccctaaaagacctcttaataatgattgttgccagtgactgattaattttattttacttaaaataagaaaaggagcactttaattacaactgaaaaatcagattgttttgcagtccttcctatcttacactaatttgaactcttaaagattgctgcttttttttgatattgtcaataatgaaacccaattgtaaaacagtcaccatttactaccagtaacttttagttaatgtcttacaaggaaaaagacacaataagaagagtttaattttttttttttttttgagcctgggcgacagagtgagactccgtctcaaaaaaaaaaaaaaaaagaaatgtttcattttggtttttcaccaaccttcctttgataggacaaagcagatactaagagggggaggaaaggctgttctgtgtctgaacccagttgggctagtccccaagaggagctgagagccatgtactctaatgcctcccttttcttcccccagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctgggtaagaatgcctttttttttttttcatagtcaaagttagctatggagtttctgtagtattcactactccagacctttttcaagttgaattttttttctttttccctatgtctgttcttacgtattttttttaaacttttatttcagtagtgtttggggaacaagtagtgtttggttgcatggaaaagttcttcagtggtgatttctgagattttggtgcacccatcacccaagggtagtcttttttatccatcaagtctgtacccaatgtgtagtctttgtttttttctttttttttttttttgagactgagtctcattctatcacccaggctggagtggagtggtatgatcttgactcactgcaacatctgcctcccgggttcaagtgattctcctgcctcagcctcctgagtcgctgggattactgagattgtgccactgcattccagcctgggcgacagagtgagacccagactcagctgaaaaataataatattattaaaagaatttaaaataaagtgttccatagatgtgaaccctgcgtagattatacacaccagtctgccatttaaaaggtttgttgttcttgggcaacctctttaaatacccttagcctccattttctcatctggacagtggacattgtgatggtttctacctccctgggctgttatgaggatcctgacacagtattagcacttggcaaacgttagttttcattatcatcatcattataattattatgaaaatagataagggcattatcctgtaccctcaaaggagtaaaagggggaaaatgagtcattaaactttctcttctgggaacta

SEQ ID NO: 422462 - DNA, 2253 bp, Homo sapiens
gattggcttcgagggccagaatcggcaaagggccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccgggcatggtggcgcaagcctgtagtcccagctactcgggaggctggggcaggagaatcacttgagcccaggagttggaggccgcagtgagctgtgatcatgccactgcattccagcctgggcgacagagtgagacccagactcagctgaaaaataataatattattaaaagaatttaaaataaagtgttccatagatgtg

SEQ ID NO: 422463 - DNA, 3199 bp, Homo sapiens
  misc_feature (3199)..(3199): n is a, c, g, or t
gattggcttcgagggccagaatcggcaaagggccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagcctcgggcgaggccgtccggccgcacccctcctgctcagctgcggtcgccatggccaatgacagctgcgggcccggcgagccgagctcgagcgagcgagaccggcagtactgcgagctgtgcgggaagatggagaacctgctgcgctgcagccgcagctccttctgctgcaaggagcgccagcgccaggactggaagaagcacaagctcgtgtgccagggcagcgagggcgccctcggccacggagggggccctcaccaggactccggccccgcgccgcccgctgcagcgccgccgtccagggaccgggccctggaggccaggaaggcagcgaggcgccgggacagcgcctccggggacgcagccaaggcaaaggccaagtccgcggccgaccccgcggcggccgcgtccccgcctcgcgcgtccccgggccggacaaaagccatggctgcttgttatccggtcaatggaacgggttatgtacgtcatgttgataatccaaatggagacggaagacgtgtgaaatgtattacattacgttaaagaacgggatgccaagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccggactacaggcgcctgccaccatgcctggctaattttttgtatttttagtagggacggggtttcaccgtgttagccactgtccccttttctttctgacccagcccgatgtctgtcccagtgtcttactgtctgcaggcccctccaccaacctgagacctgaattcctgctaggctaggaaaggcctgctgccaatgtgtggaagtttagtagccagggtaggaaaaggcctgccactgaagaacctggagagttcgaatttctctgtgagcaactttaactcctggagccaggtttatcatggtgctggaggctccttcctgagcacccaacagtctcctggaagaaagagatcagataacaagacgaaatcctgctcggcagtacctgagatggccaagcaattcttcaggcctggggcccaagtcactcgcagcagctctgggtcagggctaggtacggatactgggcactggactgagctcacaggatggcagagatcccgggggtcaagaagacaaagacgcccatctgagccaaggctggcaatgctgggcccagggccctggccccagctcccacttcagan

SEQ ID NO: 422464 - DNA, 2547 bp, Homo sapiens
gattggcttcgagggccagaatcggcaaagggccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccgggcatggtggcgcaagcctgtagtcccagctactcgggaggctggggcaggagaatcacttgagcccaggagttggaggccgcagtgagctgtgatcatgccactgcattccagcctgggcgacagagtgagacccagactcagctgaaaaataataatattattaaaagaatttaaaataaagtgttccatagatgtgaaccctgcgtagattatacacaccagtctgccatttaaaaggtttgttgttcttgggcaacctctttaaatacccttagcctccattttctcatctggacagtggacattgtgatggtttctacctccctgggctgttatgaggatcctgacacagtattagcacttggcaaacgttagttttcattatcatcatcattataattattatgaaaatagataagggcattatcctgtaccctcaaaggagtaaaagggggaaaatgagtcattaaactttctcttctgggaacta

SEQ ID NO: 422465 - DNA, 3217 bp, Homo sapiens
  misc_feature (3217)..(3217): n is a, c, g, or t
tctgtttggacaagcggtgaaccctcagagactttatcttactcttatcctttaatacagtgaatctatataactatatccagagacagttccctttgttttaaattgttattgggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagcctcgggcgaggccgtccggccgcacccctcctgctcagctgcggtcgccatggccaatgacagctgcgggcccggcgagccgagctcgagcgagcgagaccggcagtactgcgagctgtgcgggaagatggagaacctgctgcgctgcagccgcagctccttctgctgcaaggagcgccagcgccaggactggaagaagcacaagctcgtgtgccagggcagcgagggcgccctcggccacggagggggccctcaccaggactccggccccgcgccgcccgctgcagcgccgccgtccagggaccgggccctggaggccaggaaggcagcgaggcgccgggacagcgcctccggggacgcagccaaggcaaaggccaagtccgcggccgaccccgcggcggccgcgtccccgcctcgcgcgtccccgggccggacaaaagccatggctgcttgttatccggtcaatggaacgggttatgtacgtcatgttgataatccaaatggagacggaagacgtgtgaaatgtattacattacgttaaagaacgggatgccaagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccggactacaggcgcctgccaccatgcctggctaattttttgtatttttagtagggacggggtttcaccgtgttagccactgtccccttttctttctgacccagcccgatgtctgtcccagtgtcttactgtctgcaggcccctccaccaacctgagacctgaattcctgctaggctaggaaaggcctgctgccaatgtgtggaagtttagtagccagggtaggaaaaggcctgccactgaagaacctggagagttcgaatttctctgtgagcaactttaactcctggagccaggtttatcatggtgctggaggctccttcctgagcacccaacagtctcctggaagaaagagatcagataacaagacgaaatcctgctcggcagtacctgagatggccaagcaattcttcaggcctggggcccaagtcactcgcagcagctctgggtcagggctaggtacggatactgggcactggactgagctcacaggatggcagagatcccgggggtcaagaagacaaagacgcccatctgagccaaggctggcaatgctgggcccagggccctggccccagctcccacttcagan

SEQ ID NO: 422466 - DNA, 3166 bp, Homo sapiens
gattggcttcgagggccagaatcggcaaagggccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagcctcgggcgaggccgtccggccgcacccctcctgctcagctgcggtcgccatggccaatgacagctgcgggcccggcgagccgagctcgagcgagcgagaccggcagtactgcgagctgtgcgggaagatggagaacctgctgcgctgcagccgcagctccttctgctgcaaggagcgccagcgccaggactggaagaagcacaagctcgtgtgccagggcagcgagggcgccctcggccacggagggggccctcaccaggactccggccccgcgccgcccgctgcagcgccgccgtccagggaccgggccctggaggccaggaaggcagcgaggcgccgggacagcgcctccggggacgcagccaaggcaaaggccaagtccgcggccgaccccgcggcggccgcgtccccgcctcgcgcgtccccgggccggacaaaagccatggctgcttgttatccggtcaatggaacgggttatgtacgtcatgttgataatccaaatggagacggaagacgtgtgaaatgtattacattacgttaaagaacgggatgccaagacaggaaccttgtctctgttgaagagcatcaagggaagattacatacgccttgaaaccgaaccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccgggcatggtggcgcaagcctgtagtcccagctactcgggaggctggggcaggagaatcacttgagcccaggagttggaggccgcagtgagctgtgatcatgccactgcattccagcctgggcgacagagtgagacccagactcagctgaaaaataataatattattaaaagaatttaaaataaagtgttccatagatgtgaaccctgcgtagattatacacaccagtctgccatttaaaaggtttgttgttcttgggcaacctctttaaatacccttagcctccattttctcatctggacagtggacattgtgatggtttctacctccctgggctgttatgaggatcctgacacagtattagcacttggcaaacgttagttttcattatcatcatcattataattattatgaaaatagataagggcattatcctgtaccctcaaaggagtaaaagggggaaaatgagtcattaaactttctcttctgggaacta

SEQ ID NO: 422467 - DNA, 3147 bp, Homo sapiens
gattggcttcgagggccagaatcggcaaagggccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagcctcgggcgaggccgtccggccgcacccctcctgctcagctgcggtcgccatggccaatgacagctgcgggcccggcgagccgagctcgagcgagcgagaccggcagtactgcgagctgtgcgggaagatggagaacctgctgcgctgcagccgcagctccttctgctgcaaggagcgccagcgccaggactggaagaagcacaagctcgtgtgccagggcagcgagggcgccctcggccacggagggggccctcaccaggactccggccccgcgccgcccgctgcagcgccgccgtccagggaccgggccctggaggccaggaaggcagcgaggcgccgggacagcgcctccggggacgcagccaaggcaaaggccaagtccgcggccgaccccgcggcggccgcgtccccgcctcgcgcgtccccgggccggacaaaagccatggctgcttgttatccggtcaatggaacgggttatgtacgtcatgttgataatccaaatggagacggaagacgtgtgaaatgtattacattacgttaaagaacgggatgccaagccctgcctgatgtggctctgggaattcctgcagagaagagcaggggtggccaggagatagtgagcagctcccaggagctagtgacacctggtgattcggctgtgtatatctcctaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccgggcatggtggcgcaagcctgtagtcccagctactcgggaggctggggcaggagaatcacttgagcccaggagttggaggccgcagtgagctgtgatcatgccactgcattccagcctgggcgacagagtgagacccagactcagctgaaaaataataatattattaaaagaatttaaaataaagtgttccatagatgtgaaccctgcgtagattatacacaccagtctgccatttaaaaggtttgttgttcttgggcaacctctttaaatacccttagcctccattttctcatctggacagtggacattgtgatggtttctacctccctgggctgttatgaggatcctgacacagtattagcacttggcaaacgttagttttcattatcatcatcattataattattatgaaaatagataagggcattatcctgtaccctcaaaggagtaaaagggggaaaatgagtcattaaactttctcttctgggaacta

SEQ ID NO: 422468 - DNA, 3815 bp, Homo sapiens
  misc_feature (3815)..(3815): n is a, c, g, or t
gagccggggtgaatctggaggggccgggccgagcccgggggcgctttcgcacgcgaagcaaccgctagagcaggacctggtctcccaagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacaccccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtgggggtggtgtgggaagagcttcagccagagctccagtctgattgcacaccagggcatgcacacaggggagaaaccctacgagttgcctgacatgtggggaagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacagtctcgctctgttgcccaggctggagtgcagtggtgcaatctcagctcactgcaagctccgcctcccaggttcacgccattcttctgcctcagcctcctaagtagctgggactacaggcgcctgccaccatgcctggctaattttttgtatttttagtagggacggggtttcaccgtgttagccactgtccccttttctttctgacccagcccgatgtctgtcccagtgtcttactgtctgcaggcccctccaccaacctgagacctgaattcctgctaggctaggaaaggcctgctgccaatgtgtggaagtttagtagccagggtaggaaaaggcctgccactgaagaacctggagagttcgaatttctctgtgagcaactttaactcctggagccaggtttatcatggtgctggaggctccttcctgagcacccaacagtctcctggaagaaagagatcagataacaagacgaaatcctgctcggcagtacctgagatggccaagcaattcttcaggcctggggcccaagtcactcgcagcagctctgggtcagggctaggtacggatactgggcactggactgagctcacaggatggcagagatcccgggggtcaagaagacaaagacgcccatctgagccaaggctggcaatgctgggcccagggccctggccccagctcccacttcagan

SEQ ID NO: 422469 - DNA, 2254 bp, Homo sapiens
  misc_feature (216)..(216): n is a, c, g, or t
  misc_feature (221)..(221): n is a, c, g, or t
  misc_feature (442)..(442): n is a, c, g, or t
  misc_feature (446)..(446): n is a, c, g, or t
  misc_feature (2254)..(2254): n is a, c, g, or t
aggttcaaacaagaacttttggtggaaggtggtggtactttgtaaataataaaagattaagggtttcctatttgacagattcaaagagattttaatcgattatgcaacaaatttggtcaagttgtacacggtgctccatccagatggccagtcggctcaaggggccaaggatcaggctctgagggaataaatttaatcaaggtctttgcaaaacanaagcncagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggccagattaaaagatatcaatttgtagttctccctaaaaaaaaaaaaaaaaaactcgagtttttttntttntttttttttttttttttcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacagtctcgctctgttgcccaggctggagtgcagtggtgcaatctcagctcactgcaagctccgcctcccaggttcacgccattcttctgcctcagcctcctaagtagctgggactacaggcgcctgccaccatgcctggctaattttttgtatttttagtagggacggggtttcaccgtgttagccactgtccccttttctttctgacccagcccgatgtctgtcccagtgtcttactgtctgcaggcccctccaccaacctgagacctgaattcctgctaggctaggaaaggcctgctgccaatgtgtggaagtttagtagccagggtaggaaaaggcctgccactgaagaacctggagagttcgaatttctctgtgagcaactttaactcctggagccaggtttatcatggtgctggaggctccttcctgagcacccaacagtctcctggaagaaagagatcagataacaagacgaaatcctgctcggcagtacctgagatggccaagcaattcttcaggcctggggcccaagtcactcgcagcagctctgggtcagggctaggtacggatactgggcactggactgagctcacaggatggcagagatcccgggggtcaagaagacaaagacgcccatctgagccaaggctggcaatgctgggcccagggccctggccccagctcccacttcagan

SEQ ID NO: 422470 - DNA, 2200 bp, Homo sapiens
  misc_feature (216)..(216): n is a, c, g, or t
  misc_feature (221)..(221): n is a, c, g, or t
  misc_feature (388)..(388): n is a, c, g, or t
  misc_feature (392)..(392): n is a, c, g, or t
  misc_feature (2200)..(2200): n is a, c, g, or t
aggttcaaacaagaacttttggtggaaggtggtggtactttgtaaataataaaagattaagggtttcctatttgacagattcaaagagattttaatcgattatgcaacaaatttggtcaagttgtacacggtgctccatccagatggccagtcggctcaaggggccaaggatcaggctctgagggaataaatttaatcaaggtctttgcaaaacanaagcncagaagggagcctatatagaactaacactgaaaaatacatttattttactaaatactgactacatttctctgttaatattgagctaaatgttaaaaaatggccagattaaaagatatcaatttgtagttctccctaaaaaaaaaaaaaaaaaactcgagtttttttntttntttttttttttttttttcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacagtctcgctctgttgcccaggctggagtgcagtggtgcaatctcagctcactgcaagctccgcctcccaggttcacgccattcttctgcctcagcctcctaagtagctgggactacaggcgcctgccaccatgcctggctaattttttgtatttttagtagggacggggtttcaccgtgttagccactgtccccttttctttctgacccagcccgatgtctgtcccagtgtcttactgtctgcaggcccctccaccaacctgagacctgaattcctgctaggctaggaaaggcctgctgccaatgtgtggaagtttagtagccagggtaggaaaaggcctgccactgaagaacctggagagttcgaatttctctgtgagcaactttaactcctggagccaggtttatcatggtgctggaggctccttcctgagcacccaacagtctcctggaagaaagagatcagataacaagacgaaatcctgctcggcagtacctgagatggccaagcaattcttcaggcctggggcccaagtcactcgcagcagctctgggtcagggctaggtacggatactgggcactggactgagctcacaggatggcagagatcccgggggtcaagaagacaaagacgcccatctgagccaaggctggcaatgctgggcccagggccctggccccagctcccacttcagan

SEQ ID NO: 422471 - DNA, 2094 bp, Homo sapiens
ttggcagagatggggtttcaccatgttggccaggctggtcttgaactcctgaccttaagtaatctgcctgcctcggcctcccaaagtgctgggactacaggcctgagccaccacggggccccagtgtgcagtcttttatcccctcagtctgtacccagtgtgtagtcttttatccctcacccccctgctcccaccctttccccctgggttgaatatttcaaatctatttcttccttaaatcttactcaaaggaaatccaataccatagtcagtttcaccaaggatgaatttcttgacccagaaaggaaagctcattttagggagatggtcagtttaggtatgtgtctgaattttatttaagatagatgaacgtggatatatagttatgcatttgggcctgaatttttttttctagttgttcttttcactgagctttcccaagaatccccccagaattaaaaaaaaaaaattactatctcctctccctggcatataaaatggttgggattagatttaccaaaccattacatctcccttttgtctgcctgcaaacagattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccgggcatggtggcgcaagcctgtagtcccagctactcgggaggctggggcaggagaatcacttgagcccaggagttggaggccgcagtgagctgtgatcatgccactgcattccagcctgggcgacagagtgagacccagactcagctgaaaaataataatattattaaaagaatttaaaataaagtgttccatagatgtgaaccctgcgtagattatacacaccagtctgccatttaaaaggtttgttgttcttgggcaacctctttaaatacccttagcctccattttctcatctggacagtggacattgtgatggtttctacctccctgggctgttatgaggatcctgacacagtattagcacttggcaaacgttagttttcattatcatcatcattataattattatgaaaatagataagggcattatcctgtaccctcaaaggagtaaaagggggaaaatgagtcattaaactttctcttctgggaacta

SEQ ID NO: 422472 - DNA, 1886 bp, Homo sapiens
gattggcttcgagggccagaatcggcaaagggccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagcctcgggcgaggccgtccggccgcacccctcctgctcagctgcggtcgccatggccaatgacagctgcgggcccggcgagccgagctcgagcgagcgagaccggcagtactgcgagctgtgcgggaagatggagaacctgctgcgctgcagccgcagctccttctgctgcaaggagcgccagcgccaggactggaagaagcacaagctcgtgtgccagggcagcgagggcgccctcggccacggagggggccctcaccaggactccggccccgcgccgcccgctgcagcgccgccgtccagggaccgggccctggaggccaggaaggcagcgaggcgccgggacagcgcctccggggacgcagccaaggcaaaggccaagtccgcggccgaccccgcggcggccgcgtccccgcctcgcgcgtccccgggccggacaaaagccatggctgcttgttatccggtcaatggaacgggttatgtacgtcatgttgataatccaaatggagacggaagacgtgtgaaatgtattacattacgttaaagaacgggatgccaagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctgggacttccagttccccagccagatggggtcacaatgctgcagaaaagtgaagagctttggaatgaagatctcccggacttcaaggagattcagaaaacgtccagtgcaggtgggaaatgaatgggagctagcattccaccaacaaagtcagccctgggattctaaactcggacaagccagcactggttaagggctgaggggaaccaggcactcagtgcacccagtttactattctgtggtgtggaaagcacaggacttgagaagcaggtggcacccaggaaagcctgttcccctaagtaagtttgaactttagttacttga

SEQ ID NO: 422473 - DNA, 2960 bp, Homo sapiens
gagccggggtgaatctggaggggccgggccgagcccgggggcgctttcgcacgcgaagcaaccgctagagcaggacctggtctcccaagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacaccccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtgggggtggtgtgggaagagcttcagccagagctccagtctgattgcacaccagggcatgcacacaggggagaaaccctacgagttgcctgacatgtggggaagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattctttt

SEQ ID NO: 422474 - DNA, 3350 bp, Homo sapiens
gagccggggtgaatctggaggggccgggccgagcccgggggcgctttcgcacgcgaagcaaccgctagagcaggacctggtctcccaagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacaccccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtgggggtggtgtgggaagagcttcagccagagctccagtctgattgcacaccagggcatgcacacaggggagaaaccctacgagttgcctgacatgtggggaagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacggagtctcactctgtcacccaggcgctcctgcctataatcctaactctttgggaggccgaggtgggtggatcacttgaggtcagaagttcaagaccagcctggccaacatggtgaaaccccacctctactaaaaataaaaaaattagccaggtgtggtggcgcctacctgttgtctcagctactcaagaggctgaggcaagacaatcacttgaacccaggaggtggagcttg

SEQ ID NO: 422475 - DNA, 1005 bp, Homo sapiens
gattggcttcgagggccagaatcggcaaagggccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcagttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaaccctgcgctcctccgcagcctgggccgggccgcccgggacgctgaggcggtggcggcagccgagggggccggtcttgcgctccgcaggctcgcgcgcccgagcccgggttgccgttcgccgcacaggccgcgttctctcagcccacggcggcgattaggcgctgaggcggccgc

SEQ ID NO: 422476 - DNA, 1083 bp, Homo sapiens
gagccggggtgaatctggaggggccgggccgagcccgggggcgctttcgcacgcgaagcaaccgctagagcaggacctggtctcccaagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacaccccagaaagtgtcaggagcacagaaacttgaggaagtacagcctggagccagtgtcccagtgtcctttccattggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattctttt

SEQ ID NO: 422477 - DNA, 911 bp, Homo sapiens
gagccggggtgaatctggaggggccgggccgagcccgggggcgctttcgcacgcgaagcaaccgctagagcaggacctggtctcccaagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgaaacagcttcctgcgtacatggctgccctgtgtgattccagttgcagcctcacctcctttgcctctctgaaccaaagaagccagccctgcttaccccagttcccaaacacaggaagtgattttctgcctgagctttctgagttctgttccctcccaccccagggctctccatgcttattcattgcatttccttcctcattgcttttacccagtctgctgttttgggaagccctgacatgtattttggtgcctacatattttatcttctgatctcactgaaaataaaattggattttacttgttttc

SEQ ID NO: 422478 - DNA, 850 bp, Homo sapiens
gagccggggtgaatctggaggggccgggccgagcccgggggcgctttcgcacgcgaagcaaccgctagagcaggacctggtctcccaagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgctgtagctgtctttgcttcccttccggtggaggtgaccagtttgtaatgaacttctggatctccagtcagatactatggaggagagagtgatggagggctgaggagaggcctcaggttgttatttggttgggaaccaatggggaccatcccagacacatgggtttgtctgtccctgacttctgcctctgagattgtctttgttggtctttgtttaataaacgccccgaccttcctcatgattgca

SEQ ID NO: 422479 - DNA, 406 bp, Homo sapiens
gggtttaagttaaatttttttaaaaactaaagtgactggcactaagtgaacttgagattatcctcagcttcaagttcctaagataagggctttcttaagctttcagatacatgtatcctctagatgtagacaataatgtcccatttctaagtcttttcctttgcttctccttaagttgattgtacttccaaatttgctgttattttttttcctaatactgtgatttatttgatctacagacaggaaccttgtctctgttgaagagcatcaagggaagattacatacgccttgaaaccgaagtgtgttgttaccgacttaatgtgcagtaactcctcagatatctgttaaggcacttcccagatgtgatgccagtcttcttacctgtactgaaagatgtttagctta

SEQ ID NO: 422480 - DNA, 926 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgatgtcttcccagtgactctccttggggcctggggaaaccacaagggagcttggattcattcacccattgctgccttgctgtgtgcctcagaggggctcagaggtggaaaataaatatgaaaaagcatccttgtcttctagaatctcgtcggctgctgggaagaccaaggggccagccatcgcagggagcataagcactgagacaggcacacgtgcctgcccggctatcgtagccaggctggcagccttgcaactccctggggaagaacaatctaggaacattctggggtgtggagcaggaagggagtgtcacatgcaaaaggcaggatcagccaaagcagaggggctgaagaagcagtgattcccccacctaatgtcagaagtaaaatcagttcatggtgaaaatttggggaaacaaaatcatgcagcaaaattgcctattaaaccccacacggaggtaaaaatcggttcatattgtggttatgtatctattctcttatgatgtgtatttatgtgcttatgtaagacctaaaaacaataatttttaaataaaccagttatttttaataag

SEQ ID NO: 422481 - DNA, 503 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcagcaaaacacccacccccttgaaatgaaacgtggagctcacatatatgatgcacgaatgttctcatgttgaaggacaggaagaggaatggcatcagctatgagaccaccctgacccccacccgctgccccatcctacacccgaggtggcccctgaagcatgacctccagggatcttcacagtttgaagagccgctgatatactctaatacttgcagtaatattttttaatagaatgcaatattggatgtacacaaaaggatacaagcagcatacatttacaatataaatctaa

SEQ ID NO: 422482 - DNA, 3753 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcggcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422483 - DNA, 3601 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcggcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422484 - DNA, 3867 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422485 - DNA, 7674 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcagactgaagtggccgcctccccatcgggtgcctggcagaggctccatagagtcaaccaagaccttcaaagtgagcttgaagcccagtgccagcgccaggagctgattacacaccagattcagaccctgaagcgtagctatggggaggccaaggacacgatccggcaccacgaggctgagatccggagccttcaggcacggctcagcaatgcggccgctgagctagccatcaaggagcaggcgctggccaagctcaagggcgacctgaagcgggagcagggccgggtccgcgagcagctggaggagcggcaacacagcgaggcggcgctgagcagccagctgagggctagcgagcagaagctcaagagtgctgaggccctgctgctggagaagacgcaggagctacggggcctggagacacagcaggcgctgcagcgggaccggcagaaggaggtccagaggctgcaggagcgcattgccgacctcagccagcaactgggcgccagtgagcaggcgcagcggctgatggaggagaagctgcagagaaactatgagctgctgctggagagctgtgagaaggagaagcaggcattgctgcagaacctaaaggaagtggaagacaaggccagcgcctatgaggaccagctgcagggtcaggcacagcaggtggagaccctgcagaaggagaagctgagcgccactttcgagggcagtgagcaggtgcaccagctggaggagcagctggaggcacgagaggccagcgtgcgcaggctcgcagagcacgtgcagagcctctgtgacgagcgggacctcctcagacagcggttccaggagctgacagagcgcgtggccacgtccgacgaggatgtggctgagctccgggaaaagctgaggagaagagaggctgacaaccagagcctggagcactcctaccagagggtctccagccagctgcagagcatgcacactctgctgagagagaaggaggaagagctggagcgcattaaggaagcacatgagaaggttctggagaagaaggagcaggacctcaatgaggctttggttaaaatggttgccttggggagcagcttagaggaaacagaaattaagctccaggcaaaagaagagattttaaggaaatttgcaagtgaatctccaaaggacatggaagagccacggagtacccctgaagagacagaaagggatggcactttgctcccaggccaaccagtccaagccactagggcacctctaggcctcccacacacaaggctcgaggatgaggacgaggacctgggggctcctccgggggaagagtacggtgatggcagccccagtagggaagacagcatggtgcccccaaagtcagtggaagtgcttgacagggagggccatcagcagggcacagccaaactcgaccaaggggcacctggtgttaaaaggcaaagaatccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaggaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422486 - DNA, 7737 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcagactgaagtggccgcctccccatcgggtgcctggcagaggctccatagagtcaaccaagaccttcaaagtgagcttgaagcccagtgccagcgccaggagctgattacacaccagattcagaccctgaagcgtagctatggggaggccaaggacacgatccggcaccacgaggctgagatccggagccttcaggcacggctcagcaatgcggccgctgagctagccatcaaggagcaggcgctggccaagctcaagggcgacctgaagcgggagcagggccgggtccgcgagcagctggaggagcggcaacacagcgaggcggcgctgagcagccagctgagggctagcgagcagaagctcaagagtgctgaggccctgctgctggagaagacgcaggagctacggggcctggagacacagcaggcgctgcagcgggaccggcagaaggaggtccagaggctgcaggagcgcattgccgacctcagccagcaactgggcgccagtgagcaggcgcagcggctgatggaggagaagctgcagagaaactatgagctgctgctggagagctgtgagaaggagaagcaggcattgctgcagaacctaaaggaagtggaagacaaggccagcgcctatgaggaccagctgcagggtcaggcacagcaggtggagaccctgcagaaggagaagctgagcgccactttcgagggcagtgagcaggtgcaccagctggaggagcagctggaggcacgagaggccagcgtgcgcaggctcgcagagcacgtgcagagcctctgtgacgagcgggacctcctcagacagcggttccaggagctgacagagcgcgtggccacgtccgacgaggatgtggctgagctccgggaaaagctgaggagaagagaggctgacaaccagagcctggagcactcctaccagagggtctccagccagctgcagagcatgcacactctgctgagagagaaggaggaagagctggagcgcattaaggaagcacatgagaaggttctggagaagaaggagcaggacctcaatgaggctttggttaaaatggttgccttggggagcagcttagaggaaacagaaattaagctccaggcaaaagaagagattttaaggaaatttgcaagtgaatctccaaaggacatggaagagccacggagtacccctgaagagacagaaagggatggcactttgctcccaggccaaccagtccaagccactagggcacctctaggcctcccacacacaaggctcgaggatgaggacgaggacctgggggctcctccgggggaagagtacggtgatggcagccccagtagggaagacagcatggtgcccccaaagtcagtggaagtgcttgacagggagggccatcagcagggcacagccaaactcgaccaaggggcacctggtgttaaaaggcaaagaatccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaggaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422487 - DNA, 6089 bp, Homo sapiens
aaggtttgtttgttttgttgattattgtatcttactccatggttcccgttcccccctcgttttgacttcttacaggtagagattagttcttcctgttactctagaggactgactacactttccacaggaaaatgtttggatgtcaccttgctgacatctcccgagtgttaccttccttccttctcctcctgtcttagaaggaagtggcatcatttacctacaccttgtgtcctgcgcttgtttaggatttgttgtcaagactgcgtactttttgttttgtgaaacaaacagctgcaggtgctgtgctcctcccgcctgtccctcttcctggcgctctcttgtcctttagtctttgttttgcttcttagtgtgttccattattcagttttgtttggtttatttctcctagaagctgtttggttaaagctgttttctgatgttattgtccatgttttctgtttacctggaagcagctacttactaaaaaaaaaaaaaaagaaaatttgttggatttttttaatgggaaaaaaaaataaagttgtacaaaggataaaagccaaagccatcaaggagctttctgtggttgttcctggccagaggtgtgacactcagaactgggaggcccgagtgttactaaccagtatttaatcggtttttttaagactgaagtggccgcctccccatcgggtgcctggcagaggctccatagagtcaaccaagaccttcaaagtgagcttgaagcccagtgccagcgccaggagctgattacacaccagattcagaccctgaagcgtagctatggggaggccaaggacacgatccggcaccacgaggctgagatccggagccttcaggcacggctcagcaatgcggccgctgagctagccatcaaggagcaggcgctggccaagctcaagggcgacctgaagcgggagcagggccgggtccgcgagcagctggaggagcggcaacacagcgaggcggcgctgagcagccagctgagggctagcgagcagaagctcaagagtgctgaggccctgctgctggagaagacgcaggagctacggggcctggagacacagcaggcgctgcagcgggaccggcagaaggaggtccagaggctgcaggagcgcattgccgacctcagccagcaactgggcgccagtgagcaggcgcagcggctgatggaggagaagctgcagagaaactatgagctgctgctggagagctgtgagaaggagaagcaggcattgctgcagaacctaaaggaagtggaagacaaggccagcgcctatgaggaccagctgcagggtcaggcacagcaggtggagaccctgcagaaggagaagctgagcgccactttcgagggcagtgagcaggtgcaccagctggaggagcagctggaggcacgagaggccagcgtgcgcaggctcgcagagcacgtgcagagcctctgtgacgagcgggacctcctcagacagcggttccaggagctgacagagcgcgtggccacgtccgacgaggatgtggctgagctccgggaaaagctgaggagaagagaggctgacaaccagagcctggagcactcctaccagagggtctccagccagctgcagagcatgcacactctgctgagagagaaggaggaagagctggagcgcattaaggaagcacatgagaaggttctggagaagaaggagcaggacctcaatgaggctttggttaaaatggttgccttggggagcagcttagaggaaacagaaattaagctccaggcaaaagaagagattttaaggaaatttgcaagtgaatctccaaaggacatggaagagccacggagtacccctgaagagacagaaagggatggcactttgctcccaggccaaccagtccaagccactagggcacctctaggcctcccacacacaaggctcgaggatgaggacgaggacctgggggctcctccgggggaagagtacggtgatggcagccccagtagggaagacagcatggtgcccccaaagtcagtggaagtgcttgacagggagggccatcagcagggcacagccaaactcgaccaaggggcacctggtgttaaaaggcaaagaatccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaggaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422488 - DNA, 2249 bp, Homo sapiens
ccacgcgtctgccacgcgtcctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422489 - DNA, 3810 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422490 - DNA, 3747 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422491 - DNA, 3650 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctgtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422492 - DNA, 4344 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaagaaggaaagcaacaacacggcggcgcgggaggggagatgttccatgaaggcgcgaaaaaacaacaaaacataaataataaagaaaaagcagccagcaacacagagggagagactaaaaaagagaacaagagacaagagaaaaaaacaaaaaaaaagacgagaaggagaaaagaaggcaggaagaaagatacaatgagcaaaggaaaaagagaagaaaaccataacacgaactatggagggaagaagaaagaagaagagcaaaagaagaaaaaaacgagaaagaagaaaagaagaaggaaagagggataaaaaataaacgagaagaaggaggagaagaaagagaaaaaagcagaaacagacaaggaagaagcg

SEQ ID NO: 422493 - DNA, 4292 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaatccccggcccctctccttccttccttccttccttcctccgctcgttcctttcttggtctccagtaaccctggtcttttcataactgctcgagattgttgacctgcagcccaggtttcagactctgattgcaaaaaacaaatgaattccccccaggaatcattcaaaatgggggaaggtttgggggtttgggttttttttttaccttttggaaaagaaaccgtcacattgctttggaaaaggttgagaggagacccctgttaagtcaagaagaaagtacagaggatgtcagaatctgatgagaacagcacattagtgtttattgagactccgatcttaactctcatttaattaatctgagctctgaaaacctatcttgcagcatttatctttaaaagagcctggttaaagtaaacctatactaaca

SEQ ID NO: 422494 - DNA, 1994 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagtgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422495 - DNA, 2717 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctgatctctctgtcattttaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422496 - DNA, 4545 bp, Homo sapiens
  misc_feature (3842)..(3842): n is a, c, g, or t
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggttcagagaaaaagctatgcggaacantccagcttggcctgcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaagaaggaaagcaacaacacggcggcgcgggaggggagatgttccatgaaggcgcgaaaaaacaacaaaacataaataataaagaaaaagcagccagcaacacagagggagagactaaaaaagagaacaagagacaagagaaaaaaacaaaaaaaaagacgagaaggagaaaagaaggcaggaagaaagatacaatgagcaaaggaaaaagagaagaaaaccataacacgaactatggagggaagaagaaagaagaagagcaaaagaagaaaaaaacgagaaagaagaaaagaagaaggaaagagggataaaaaataaacgagaagaaggaggagaagaaagagaaaaaagcagaaacagacaaggaagaagcg

SEQ ID NO: 422497 - DNA, 3735 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcgcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422498 - DNA, 3812 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcaccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422499 - DNA, 3756 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422500 - DNA, 3689 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggttgtcttggttgttagaggaggtgcctggctttcagcccaggagggggacccatcttgcatttgctccactgccg

SEQ ID NO: 422501 - DNA, 1179 bp, Homo sapiens
tccagactgccttcagactccaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422502 - DNA, 2258 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422503 - DNA, 1262 bp, Homo sapiens
cagaaatgggtctgagggcagcaggtgctgcggaggcactgtaggagcgaggccctgtcccgggacacccatccttgctggggattccctggagcatctggtcctcctcagctgaggctgtcaggtgaagaatctctggagctggatgtggacaaatccattcacaagacaagacacggggatgggcagtctccttgctcattgcactgttttccctggctggattcgtttgatcactgcttctcttaaagagccctaagctcagaatttagctgcttaaacacatggtcttgtctctctgatttttttttcctttttcatccaagtaattttgtgaaggggaaaacatcctccaataacagcatttcccggggactctcctcctggcatgcccactaaccgcacctgcacccggctctctgactgatgccggctccaccagcggtccggtctggtccggtccggtccagtgcagggggtctaacggtgtgtttattttctcctcctgctctgtctctacccagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422504 - DNA, 979 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgatccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 422505 - DNA, 3194 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaaggtgagtctggggtccagccccctggtgggaggggcttgagggacactggggagagtagcccaaat

SEQ ID NO: 422506 - DNA, 1115 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggtacagttgccccgagtcgccctcccaggagctcggtggtcctcttccttccccaggtcctcgactcccccaccaaatggtctgcagcatctccctcagctccctggatgtggccagccagccacctgcctacgt

SEQ ID NO: 422507 - DNA, 991 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagacagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagtggggagcgcctttgcctttaaagccagcaggcaatatgccaccctggccgacgtccctaaggccatcaggatcagccaccgagaagccttccaggtggagagaaggcggctggagcgtagaactcgggcccggagccctggcagggaggaggtggcccgtctgtttggca

SEQ ID NO: 422508 - DNA, 855 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatttggcaagaaagcataagtggcaatcataaaaagtaataaaggttctttttgacctgtta

SEQ ID NO: 422509 - DNA, 575 bp, Homo sapiens
ccttggacattgagaaggcagagcacatggagaccaatgcagtggggccctcaccatccagcgacacacgccagggccgcagcgagaagagggcgttccctaggaagcgggtgagctcctggggctgggcagcacctcaggggtggctcgggggcgggtcagcatgcaccccatgcgccaagtcccctccacacaggcctgggatgtgctcctgccaggcttctctccaaccacctcctctgcatagtgacttcttgagagcaggcctgtctcctgcagcttcatatcagagccttctccgtctctgctgaaggatattctcatgcattttagatcccagatttaattaggatcactctcttcctatctgagacagcccagcaacaaggctgaatgtcacaccttcctaactctttctttcagtacaactacacccctcgtttctccactcagcccaaggtagactcggcttctgaaatcctcctgggcacccgcctgctgcttttgtagccggccaagtctaagctcatcttctcctggcttctctcttgttcacaaggtgcctagtgcctact

SEQ ID NO: 422510 - DNA, 394 bp, Homo sapiens
gtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggaggtaatagcctgggaccagatccccaccctgctcccagcagcctttccagagcatcagctgtgcccagctgtggcctgaggggttcatctagacagtcctaccctcgagggacttgcagacccctaggggagacagacgcatagatgagtcctcatagttgaggcagacctgagagctgtgggagcgtgccagt

SEQ ID NO: 422511 - DNA, 427 bp, Homo sapiens
gggtacgcctacgaggtaccgggaccggaattcccggggaggacacttacaactaaaatcgcggccgccgtcgactttttttttagatgaacaccgttttctcttgtttatttaaatttgggagccaaatggtatggagaaggtaatgatggttttcaaaatacagtaagtcttcatttaacattgttaatagaacaatgaaaactccaacttttacgtgaaacagtgtatagccagtcctcaaataactgccttttgttcaacatcctttccttgtaacaactgatgagaaaaagtatggttttgttatacatcatttctcttgaagtacaagttttcaagaacctattgacaaggttaagtgtgggcttacagtttaccaatcttagcctcagattgggctagggcagggatgacaaaccaggct

SEQ ID NO: 422512 - DNA, 5298 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaagaaaataggcacaataagtaatacatttctgcccaagtaagagccttcccttttgtggatgtaatgaaaatatcttcaagcactttataaataaattatatgtctgatactagc

SEQ ID NO: 422513 - DNA, 5500 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaagaaaataggcacaataagtaatacatttctgcccaagtaagagccttcccttttgtggatgtaatgaaaatatcttcaagcactttataaataaattatatgtctgatactagccttccattgcctggatcacatctgattgtcctggtaatttgagaaaagggtagccccttggtatggatagtagcttgatgacatggaattcagggaaaagactatgatggtgtcacttgtaactgcttttgtgctgtaaaattgtcatggattaagaagagagttggctgggtgcggtggctcacacctgtaatcctagcac

SEQ ID NO: 422514 - DNA, 2509 bp, Homo sapiens
tcggagcgggcgggggcgatcggccggggggaccgcgagcgacgggcacgcgccgccgcccgacagcgcagcaggcggcgttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaata

SEQ ID NO: 422515 - DNA, 5537 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagaggtgggtatgaaggaggaggatgggatctgattgcctttgtggtataaaggttgggtttacattttgtgggtaaatgtttcatcttggtctttaatgtgtttgattctaagaggatgtgctgtggtttaaaccagtggaactgagaacgaagtggggccggagaggacatatcaaggaacctttaggtaaggaaacacgggatttgagaccatgtctgcatttctgcagtgttgctaaatgactgttgggttggaagtcattgctttaaaattttctacttttaatttgaccgacttgttctgatgtctttctaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaagaaaataggcacaataagtaatacatttctgcccaagtaagagccttcccttttgtggatgtaatgaaaatatcttcaagcactttataaataaattatatgtctgatactagc

SEQ ID NO: 422516 - DNA, 2979 bp, Homo sapiens
tgtatgacagtgtgtaaaaagcaggctggtacggccggaatcccgggatatcgggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaagaaaataggcacaataagtaatacatttctgcccaagtaagagccttcccttttgtggatgtaatgaaaatatcttcaagcactttataaataaattatatgtctgatactagc

SEQ ID NO: 422517 - DNA, 3487 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggtaagttgagccacagagatgaacagaccctgcaggtccttaatagatgaacaccgttttctcttgtttatttaaatttgggagccaaatggtatggagaaggtaatgatggttttcaaaatacagtaagtcttcatttaacattgttaatagaacaatgaaaactccaacttttacgtgaaacagtgtatagccagtcctcaaataactgccttttgttcaacatcctttccttgtaacaactgatgagaaaaagtatggttttgttatacatcatttctcttgaagtacaagttttcaagaacctattgacaaggttaagtgtgggcttacagtttaccaatcttagcctcagattgggctagggcagggatgacaaaccaggct

SEQ ID NO: 422518 - DNA, 4161 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaagaaaataggcacaataagtaatacatttctgcccaagtaagagccttcccttttgtggatgtaatgaaaatatcttcaagcactttataaataaattatatgtctgatactagc

SEQ ID NO: 422519 - DNA, 675 bp, Homo sapiens
ctgataggactagatcgtatcttttaggtgcattgaggcagcgaaaatttttgagaactggtggtttagagaagtagaagctgccataggtttaagagttgcactaatacagcttttcacaggcctctatcacctctggtttctcaaaatggttttgcttttcattttttaacccttatggcagcggacaaacataaattgcagagattcctgactgctgacatggccctggtggcgacagtctatgcgccaatcacttttcctcctgcatctgtgctgcttttcaagcaaaaaagcaatggtaagttgagccacagagatgaacagaccctgcaggtccttaatagatgaacaccgttttctcttgtttatttaaatttgggagccaaatggtatggagaaggtaatgatggttttcaaaatacagtaagtcttcatttaacattgttaatagaacaatgaaaactccaacttttacgtgaaacagtgtatagccagtcctcaaataactgccttttgttcaacatcctttccttgtaacaactgatgagaaaaagtatggttttgttatacatcatttctcttgaagtacaagttttcaagaacctattgacaaggttaagtgtgggcttacagtttaccaatcttagcctcagattgggctagggcagggat

SEQ ID NO: 422520 - DNA, 3711 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaata

SEQ ID NO: 422521 - DNA, 4989 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacacttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaagaaaataggcacaataagtaatacatttctgcccaagtaagagccttcccttttgtggatgtaatgaaaatatcttcaagcactttataaataaattatatgtctgatactagc

SEQ ID NO: 422522 - DNA, 5165 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaagaaaataggcacaataagtaatacatttctgcccaagtaagagccttcccttttgtggatgtaatgaaaatatcttcaagcactttataaataaattatatgtctgatactagc

SEQ ID NO: 422523 - DNA, 3634 bp, Homo sapiens
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagtctctttgttacaggccctcttatagttacagattccgacacaatcggtatccctatacccgtcctgagaggccctcctctccaaaactattactaacatgccactctaaccacacacgatctcccattaacaagacgccattactcataacgccgatgaacctataactaacgtgtgctctcacagcacaacacaacgcaccattaacacattattggggtcatccacctcccctcccgcccacatactcacatatatataattgtgcactctcgcaaataatagcatcaacatcagcgcacgctacttatgatcccatagtcacctaacactgatgtcgcgacttttacaggctattctttttgctccgctcaccccctattcatcgccccgatccttccgaccttaactcgccttccagtttcaccccgtatgacccttacattggaccccttaagtgactctccgtttcctcacccaggttctacattttcatacacgttttatatttacccccctcatt

SEQ ID NO: 422524 - DNA, 677 bp, Homo sapiens
tttaatttaggcacttataaaatgttttccctctacctgctgctactctgccaagagccaccaagtgcttatatttttcattttttactcctttagtttggaaagccatatacgtttgagaaggtgttttaaaactctgtgttacacttacgatgcaaagccaaatcagaacttctgtaaggcagaactttcccaactttaaaaaaattattgtcccctctaaggagccttcttagacgttttttcctaatcacccccaaagacattttaataccacatatatattgtttatgtactatatgtatatacataaacaatacataagcaatacatctgtggtattaaaattaaaaagaatccaattatgtttacctcaaaagaacctgtttttgcttcttgggagcaatattgcccctgtgagactgcatgctataaggtaaggttgtgcttgttaaagacccaagacatgactgggttccacagtctccaaaggaagagggtgggctagtctgtttttattattattttaaaattgtataattggggtctttcttagagttcagaaaaggtatagcttactcttttttaattgtttatttagttgtaagcttggtgattgttttctgatccacattgtgtgtgttcttcaataaaatctttcatttctgcaattttac

SEQ ID NO: 422525 - DNA, 1950 bp, Homo sapiens
tcatagtcaggggctattgtggcctggacagaggcagaaagacacgacacagcaggcttccttcctgtcttgctcttatctgaagttgcagagagtgggtgggagtatgcctgaggtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 422526 - DNA, 1677 bp, Homo sapiens
tcatagtcaggggctattgtggcctggacagaggcagaaagacacgacacagcaggcttccttcctgtcttgctcttatctgaagttgcagagagtgggtgggagtatgcctgaggtgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 422527 - DNA, 1458 bp, Homo sapiens
gtcactctgcattcccgcgtgtcgtgccatgttctgtctgttccagctcacaccagctgtcctggaaggaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 422528 - DNA, 1818 bp, Homo sapiens
tcatagtcaggggctattgtggcctggacagaggcagaaagacacgacacagcaggcttccttcctgtcttgctcttatctgaagttgcagagagtgggtgggagtatgcctgaggtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 422529 - DNA, 1978 bp, Homo sapiens
tcatagtcaggggctattgtggcctggacagaggcagaaagacacgacacagcaggcttccttcctgtcttgctcttatctgaagttgcagagagtgggtgggagtatgcctgaggtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaaggttgtaattttccctttttgtcttttagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 422530 - DNA, 1897 bp, Homo sapiens
tcatagtcaggggctattgtggcctggacagaggcagaaagacacgacacagcaggcttccttcctgtcttgctcttatctgaagttgcagagagtgggtgggagtatgcctgaggtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaattgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 422531 - DNA, 248 bp, Homo sapiens
gaatgactgcttacctggacttgttgctggggaactgctatctgatgcccctcaatacttctattgttatgcctccaaaaaatctggtagagctctttggcaaactggcggtatgtattttggaagtcaaatttttatataagcatttccaagtaattttacttccttgttttttaaaaaaataatgaatttgtccaaaacattttattttattgaaataattttgaaataaaaaacgttgtgaacct

SEQ ID NO: 422532 - DNA, 1865 bp, Homo sapiens
tcatagtcaggggctattgtggcctggacagaggcagaaagacacgacacagcaggcttccttcctgtcttgctcttatctgaagttgcagagagtgggtgggagtatgcctgaggtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 422533 - DNA, 1303 bp, Homo sapiens
tcatagtcaggggctattgtggcctggacagaggcagaaagacacgacacagcaggcttccttcctgtcttgctcttatctgaagttgcagagagtgggtgggagtatgcctgaggtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtcccataaaccttaatgttaaagtcatattgtaaatgtcga

SEQ ID NO: 422534 - DNA, 1062 bp, Homo sapiens
  misc_feature (996)..(997): n is a, c, g, or t
tcatagtcaggggctattgtggcctggacagaggcagaaagacacgacacagcaggcttccttcctgtcttgctcttatctgaagttgcagagagtgggtgggagtatgcctgaggtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggcagatatctgccacnngccagtttgccaaagagctctaccagtcgtccggccgcgaatttagcagtagtagtaggcgccgc

SEQ ID NO: 422535 - DNA, 1881 bp, Homo sapiens
  misc_feature (1879)..(1879): n is a, c, g, or t
tgaagagagaaaggaagctttttctctaaaaatggtgcagctatcctctgaaccaatttccttcggtttaatgtacctgtatcttggggtttttttccacttaatttatcctggagctctttccataacaacacttggaaagcactctcatccttttttcactgctgaacagaattccactgtgtggatggaacatactctatttcaccagtcccctgtagccagtcacttggtttgtttccaatcttttgctttttcagagtaataaccttgtatgtctatcattttgtatgcatacaggtttatatgtaggaaaaattcctagagtaggattgctggaccaatggataaaagtatattgtggacagacaatgccaaattgcctttcagagactgtggccctgtgcaccccatcaggcatgtgtgactaccaaagctcctgtcagctgttttattttatctcctttccagtctcaggctcaatgcagaactttgaggtaagcttttctaaaatgtaggctcctaaacgccacagccagctctgccacatgaaggagagctcaaatgagacagaaacagcctctgggcaggatttctatcctgcacagatatattttccacattctgggaaaccgtgaagcttccagagccacaattccccagaaacacatccccctgctggtacagccaagccccagaacaagctgtgcttgcctggcacctcaaagccaagcaccatggatgccacttgccatgggtgcctgcaatttcaaataatgagaaataagaaatttcagcttctcagtccctctagccaacatttcaggtgcatgacagcctcaggtggcaagcagctactctgccggacagggcagaagatggaacaccccatccctggggaagatcacgaggtcaggagatcaagaccatcctggctaacacagtgaaaccccgtctctactgaaaatacaaaacattagctgggtgtggtggcaggcacctgtagtcccagctactcaggaggctgaggcaggagaatggcgtgaacctgggaggtggaggttgcagtgagccaagattgcgccactgcactccagcctggcaacagagtaagactccatatcaaaaaaaagagaaaagaagaagaagaaagaaagaaagaagaagaagaggaagaagaagaagtggaagaagaaggaaagaggaagaggagaagcaggagaagaacaaggagaagaagaaggagagagaagaagagacaagaagaagaaggagaagaaggagagagaagagacaagagaagaaggaagaaggaggaggagaagaaggaagaagaaaagaaggagaagaaagaagaaggaagaagaaagaacaacaaaaagaaggagaagaacaaggaagaagaacaactaaggagaaggaagaaggagaagaagaaagaagaacaaaaagaaagaagaaagaaggagaaggaagaagaaggaggaggaggagaaggagaagaagaaggagaagaacaaggagaaggagagaagaagaagagacaagaagaaagaaggagaagaagaaggaagaagaagaaaaggaagaagaaaagaggaaggaggaggaagaaggagaagaaggaagaataaggaagaaggagaacaaggagaaggaagaagaaaagaaggagaaggaggaagaaggagaagaaagaggagaagaaggaagaaagaagaaaaaagaaacaatagaagaagaggaagaaagaaaagaaaaaagaaaaagagaagaaagagggaagaaagaaaagaggaagaagaataaggaagaagaagaaaaagaaaagaaaagaaggaagaagaggaagaaagaagaaggaagaagaaaggaaganct

SEQ ID NO: 422536 - DNA, 644 bp, Homo sapiens
  misc_feature (108)..(108): n is a, c, g, or t
ccagtctcatggtgtaatactctcgccacagcatttcaagtgatgccaccgaacagtgagtcagaaagatatggacagcagcaaaccattatacagtatttctaccanacaggttccatacacaaaagcaacatcaaaagcatagattatgaggccaggtgtggtggctcacacctgtaaccccagcacttccggaggctgaggtgggcgaatcctctgaggtccggagttcgagaccagcctggccaacatagtgaaatcccgtctctataaaaatacaaaaattagccagctgtgatggcatgcacctgtaatcccagctactcgggaggctgaggcacgagaatcatttgaacccgggaggcggaggttgccgtgagctgagatctcgccattgtactccagcctggagactgtggccctgtgcaccccatcaggcatgtgtgactaccaaagctcctgtcagctgttttattttatctcctttccagtctcaggctcaatgcagaactttgaggtaagcttttctaaaatgtaggctcctaaacgccacagcctgggcgacagagtgagaccctgtctccgaaaaataaattaattgattcaaaaaagaatatgacacacaagtatgggcgatcaagctt

SEQ ID NO: 422537 - DNA, 3102 bp, Homo sapiens
  misc_feature (3100)..(3100): n is a, c, g, or t
tactggatttgagagatatatttcaacatttcaattttattgtatttaagaacttttttttctcagaaaaaaattacaaaattcattttataaaattcatccagagaaatgatttcagtcccatatggtacaaaatacctttcccaaggaatagatgatttaatttaaagcctctgttttcttttccttttataactttacttttgttttttttcacagactttctattttagaacagttttaggtttagagaaaaattgagcagatagcacagagagctcccacgtactcttcagcacacacagtttccccgattattaacatctggcatcagtgtggtacatttgatacaactgatgaaccaatattgacacgttactattaactaaagtccatagctcacattagagcaaacgctttgtgctgtacatgctatgggttttgaccaatgcccaatgtcatgtacccaccatcacagtgtcatacagaacctttcactgccctaacatcccctgcactccacctcctcatccctcccttcctctcactgcccttgcagctcctggaaatcactgatctttttactgtctttgtagttttgcctgttccagcatgtcatatcctttcagttttcagtaagtaacactctcacacatttcaaaagttaaaactgtatagaaaggaaccactgagaactctttctcccacccggtcccagccccactgttccccattatcctactaccccagggaaaccacctgattagtttcttagcctttgtctagcttttatttatgcaaatatgttttctaatttcctttctttcttacacaattaacagcatactattagtaatatactatatgcactgatctgtatcgtgtttttttaattataattattcttttaataaaatgcttcactgagagcagggaagccaccttactttcccaaaagttacacaatacatggtagtaccaaagaaatatctgctgagagaaatactattttgggaagtagttaataattttacaatatgcaatagaagcagacacatgaacagctacaatgtggatacaagttttgtcaaataatcaggagaaaaaagaataaaaattacaatggcaaatggctgtccaaattttccaagtccaactttatagtgctgtgaagaaaagcatgaatatgagactctcaataaacatttgtgcatccatgaaattgaattatttaggtttaaagatgatagaattttggaaaactgaaaataatttttgtaatttcaaggtaaaataatctttactttcagaaaacacattgtaactgtgataagccatagcatttattcatgtgtataagataaaaacacagaaagtattctactcttattatttaaggtggaaaaaggaataattgtgaaattatgtttcaattttccagcctggccatcatggccaaccccatctctactaaaaatacaaaaattagccagctgtgatggcatgcacctgtaatcccagctactcgggaggctgaggcacgagaatcatttgaacccgggaggcggaggttgccgtgagctgagatctcgccattgtactccagcctggagactgtggccctgtgcaccccatcaggcatgtgtgactaccaaagctcctgtcagctgttttattttatctcctttccagtctcaggctcaatgcagaactttgaggtaagcttttctaaaatgtaggctcctaaacgccacagccagctctgccacatgaaggagagctcaaatgagacagaaacagcctctgggcaggatttctatcctgcacagatatattttccacattctgggaaaccgtgaagcttccagagccacaattccccagaaacacatccccctgctggtacagccaagccccagaacaagctgtgcttgcctggcacctcaaagccaagcaccatggatgccacttgccatgggtgcctgcaatttcaaataatgagaaataagaaatttcagcttctcagtccctctagccaacatttcaggtgcatgacagcctcaggtggcaagcagctactctgccggacagggcagaagatggaacaccccatccctggggaagatcacgaggtcaggagatcaagaccatcctggctaacacagtgaaaccccgtctctactgaaaatacaaaacattagctgggtgtggtggcaggcacctgtagtcccagctactcaggaggctgaggcaggagaatggcgtgaacctgggaggtggaggttgcagtgagccaagattgcgccactgcactccagcctggcaacagagtaagactccatatcaaaaaaaagagaaaagaagaagaagaaagaaagaaagaagaagaagaggaagaagaagaagtggaagaagaaggaaagaggaagaggagaagcaggagaagaacaaggagaagaagaaggagagagaagaagagacaagaagaagaaggagaagaaggagagagaagagacaagagaagaaggaagaaggaggaggagaagaaggaagaagaaaagaaggagaagaaagaagaaggaagaagaaagaacaacaaaaagaaggagaagaacaaggaagaagaacaactaaggagaaggaagaaggagaagaagaaagaagaacaaaaagaaagaagaaagaaggagaaggaagaagaaggaggaggaggagaaggagaagaagaaggagaagaacaaggagaaggagagaagaagaagagacaagaagaaagaaggagaagaagaaggaagaagaagaaaaggaagaagaaaagaggaaggaggaggaagaaggagaagaaggaagaataaggaagaaggagaacaaggagaaggaagaagaaaagaaggagaaggaggaagaaggagaagaaagaggagaagaaggaagaaagaagaaaaaagaaacaatagaagaagaggaagaaagaaaagaaaaaagaaaaagagaagaaagagggaagaaagaaaagaggaagaagaataaggaagaagaagaaaaagaaaagaaaagaaggaagaagaggaagaaagaagaaggaagaagaaaggaaganct

SEQ ID NO: 422538 - DNA, 2043 bp, Homo sapiens
tactggatttgagagatatatttcaacatttcaattttattgtatttaagaacttttttttctcagaaaaaaattacaaaattcattttataaaattcatccagagaaatgatttcagtcccatatggtacaaaatacctttcccaaggaatagatgatttaatttaaagcctctgttttcttttccttttataactttacttttgttttttttcacagactttctattttagaacagttttaggtttagagaaaaattgagcagatagcacagagagctcccacgtactcttcagcacacacagtttccccgattattaacatctggcatcagtgtggtacatttgatacaactgatgaaccaatattgacacgttactattaactaaagtccatagctcacattagagcaaacgctttgtgctgtacatgctatgggttttgaccaatgcccaatgtcatgtacccaccatcacagtgtcatacagaacctttcactgccctaacatcccctgcactccacctcctcatccctcccttcctctcactgcccttgcagctcctggaaatcactgatctttttactgtctttgtagttttgcctgttccagcatgtcatatcctttcagttttcagtaagtaacactctcacacatttcaaaagttaaaactgtatagaaaggaaccactgagaactctttctcccacccggtcccagccccactgttccccattatcctactaccccagggaaaccacctgattagtttcttagcctttgtctagcttttatttatgcaaatatgttttctaatttcctttctttcttacacaattaacagcatactattagtaatatactatatgcactgatctgtatcgtgtttttttaattataattattcttttaataaaatgcttcactgagagcagggaagccaccttactttcccaaaagttacacaatacatggtagtaccaaagaaatatctgctgagagaaatactattttgggaagtagttaataattttacaatatgcaatagaagcagacacatgaacagctacaatgtggatacaagttttgtcaaataatcaggagaaaaaagaataaaaattacaatggcaaatggctgtccaaattttccaagtccaactttatagtgctgtgaagaaaagcatgaatatgagactctcaataaacatttgtgcatccatgaaattgaattatttaggtttaaagatgatagaattttggaaaactgaaaataatttttgtaatttcaaggtaaaataatctttactttcagaaaacacattgtaactgtgataagccatagcatttattcatgtgtataagataaaaacacagaaagtattctactcttattatttaaggtggaaaaaggaataattgtgaaattatgtttcaattttccagcctggccatcatggccaaccccatctctactaaaaatacaaaaattagccagctgtgatggcatgcacctgtaatcccagctactcgggaggctgaggcacgagaatcatttgaacccgggaggcggaggttgccgtgagctgagatctcgccattgtactccagcctggagactgtggccctgtgcaccccatcaggcatgtgtgactaccaaagctcctgtcagctgttttattttatctcctttccagtctcaggctcaatgcagaactttgaggtaagcttttctaaaatgtaggctcctaaacgccacagccagctctgccacatgaaggagagctcaaatgagacagaaacagcctctgggcaggatttctatcctgcacagatatattttccacattctgggaaaccgtgaagcttccagagccacaattccccagaaacacatccccctgctggtacagccaagccccagaacaagctgtgcttgcctggcacctcaaagccaagcaccatggatgccacttgccatgggtgcctgcaatttcttatttctcattatttggtcgaccggccgcgaatttagtagtagtagccgc

SEQ ID NO: 422539 - DNA, 1819 bp, Homo sapiens
  misc_feature (1817)..(1817): n is a, c, g, or t
tggtggcatgtgcctgtaattccatctacttgggaggctgaagaggagaatcgcttgaaccagggagtcggaggctgcagtaagccgagatcgcaccactgcacgccagcctggcaacagaggaagactccgtctcaaagaaaagggagggagtaactcctggccatcatggccaaccccatctctactaaaaatacaaaaattagccagctgtgatggcatgcacctgtaatcccagctactcgggaggctgaggcacgagaatcatttgaacccgggaggcggaggttgccgtgagctgagatctcgccattgtactccagcctggagactgtggccctgtgcaccccatcaggcatgtgtgactaccaaagctcctgtcagctgttttattttatctcctttccagtctcaggctcaatgcagaactttgaggtaagcttttctaaaatgtaggctcctaaacgccacagccagctctgccacatgaaggagagctcaaatgagacagaaacagcctctgggcaggatttctatcctgcacagatatattttccacattctgggaaaccgtgaagcttccagagccacaattccccagaaacacatccccctgctggtacagccaagccccagaacaagctgtgcttgcctggcacctcaaagccaagcaccatggatgccacttgccatgggtgcctgcaatttcaaataatgagaaataagaaatttcagcttctcagtccctctagccaacatttcaggtgcatgacagcctcaggtggcaagcagctactctgccggacagggcagaagatggaacaccccatccctggggaagatcacgaggtcaggagatcaagaccatcctggctaacacagtgaaaccccgtctctactgaaaatacaaaacattagctgggtgtggtggcaggcacctgtagtcccagctactcaggaggctgaggcaggagaatggcgtgaacctgggaggtggaggttgcagtgagccaagattgcgccactgcactccagcctggcaacagagtaagactccatatcaaaaaaaagagaaaagaagaagaagaaagaaagaaagaagaagaagaggaagaagaagaagtggaagaagaaggaaagaggaagaggagaagcaggagaagaacaaggagaagaagaaggagagagaagaagagacaagaagaagaaggagaagaaggagagagaagagacaagagaagaaggaagaaggaggaggagaagaaggaagaagaaaagaaggagaagaaagaagaaggaagaagaaagaacaacaaaaagaaggagaagaacaaggaagaagaacaactaaggagaaggaagaaggagaagaagaaagaagaacaaaaagaaagaagaaagaaggagaaggaagaagaaggaggaggaggagaaggagaagaagaaggagaagaacaaggagaaggagagaagaagaagagacaagaagaaagaaggagaagaagaaggaagaagaagaaaaggaagaagaaaagaggaaggaggaggaagaaggagaagaaggaagaataaggaagaaggagaacaaggagaaggaagaagaaaagaaggagaaggaggaagaaggagaagaaagaggagaagaaggaagaaagaagaaaaaagaaacaatagaagaagaggaagaaagaaaagaaaaaagaaaaagagaagaaagagggaagaaagaaaagaggaagaagaataaggaagaagaagaaaaagaaaagaaaagaaggaagaagaggaagaaagaagaaggaagaagaaaggaaganct

SEQ ID NO: 422540 - DNA, 440 bp, Homo sapiens
ctcccctctgaaaaccctatggatgaagggagcacttgaagggaacaccaagtacacaaggagaaaatgacaaaatgctgctttcctggcctctgctgctgggcagctgggtgattcagctgcaggggctgccctcctggaacctgtcgcaggagatgccccggctgcatgccaagctaggagggcccagcagctggcatgggactcgcttccatcctggggaggcaactatgtatttatcttattttcagagactgagtctccttgtgttgccccggctggtctcgaactcctgggttccagtgattctcctacctcggcctcccaaagtgctgggattacaggcatgagccactgtgtacagcccaattctccatttttaaatttactggtttatgaaatttgaaatgttgggcaccactaatttaggtctacgactt

SEQ ID NO: 422541 - DNA, 6019 bp, Homo sapiens
  misc_feature (1351)..(1351): n is a, c, g, or t
gtggaacacttctgaacctgcatttttatctggaactccagaagcagaatcctttgctaaataaatcgcagccatgagtgcgagctcagacgctgagatggctgtttttggcgaagctgctccctaccttcgaaaatcagaaaaggagcggattgaggcccaaaacaagccgtttgatgctaaaacatctgtctttgtggcggagcccaaggaatcctatgtgaagagcactatacaaagcaaagaaggagggaaagtaaccgtaaagactgaaggtggagcaactctaactgtcagggaagaccaagtcttccctatgaaccctccgaaatatgacaaaattgaggacatggccatgatgactcatctacacgagcctggagtgctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgttgactgatcgagagaatcagtccatcctgatcaccggagaatctggtgccggaaagactgtgaacaccaagcgtgtcatccaatactttgcaacaattgcagttactggagagaagaagaaggatgaatctggcaaaatgcaggggactctggaagatcaaatcatcagcgccaatcccctactggaggcctttggcaatgccaaaaccgtgaggaatgacaactcctctcgctttggtaaattcattagaatccactttggtactacagggaagctggcatctgctgatatagaaacatatcttttagaaaagtccagagttactttccagctaaaggcggaaagaagctaccatattttttatcagatcacttccaataagaagccagatctaattgaaatgctcctgatcaccaccaacccatatgactatgccttcgtcagtcagggggagatcacagttcccagtattgatgaccaagaagagttgatggccactgatagtgccattgacatcctgggcttcactcctgaagagaaagtgtccatctataaactcacaggggctgtgatgcattatgggaacatgaaattcaagcaaaagcagcgtgaggagcaagctgagccagatggcacagaagtcgctgacaaggcagcctatctccagagtctgaactctgcagacctactcaaagccctctgctaccctagggtcaaggttggcaatgagtatgtcaccaaaggccagactgtgcagcaggtgtacaatgcngtgggtgctctggccaaagccgtctacgagaagatgttcctgtggatggtcacccgcatcaaccagcagctggacaccaagcagcccaggcagtacttcatcggggtcttggacattgctggctttgaaatctttgattttaacagcctggagcagctgtgcatcaacttcaccaacgagaaactgcaacagtttttcaaccaccacatgtttgtgctagagcaggaggagtacaagaaggaaggcatcgagtggacgttcattgactttgggatggacctggctgcctgcattgagctcattgagaagccactgggcatcttctccatcctggaagaggagtgcatgttccctaaggcaacggacacctccttcaagaacaagctgtatgaccagcacctgggcaagtctgccaacttccagaagcccaaggtggtcaaaggcaaggctgaggcccacttctctctgattcactatgctggcactgtggactacaacattactggctggctggacaaaaataaggaccccctgaatgatactgtggttgggctgtaccagaagtctgcaatgaagactctagccagtctcttttccacgtatgctagtgctgaagcagatagcagcgcgaagaaaggtgctaagaaaaagggctcttctttccagactgtgtctgcccttttcagggaaaatttaaataaattgatgacgaatctgaggagcacacaccctcacttcgtacggtgtatcattcccaatgaaaccaaaactcctggggcaatggaacatgaacttgtgttgcaccagctgaggtgtaatggtgtgctggaaggcatccgcatctgtaggaaaggattcccaagcagaatcttatatggtgatttcaaacaaagatacaaggttttaaatgcaagtgctattccagagggacagttcattgacagcaagaaggcttctgagaaacttcttgcatctattgatattgatcatactcaatataaatttggacataccaaggttttcttcaaagctggacttctgggtcttctggaagaaatgagagatgaaaaattagcccaaattataacaagaacacaagctgtctgtaggggattcctaatgagggtagaatatcagaagatgttgcaaaggagagaagcacttttctgcatccagtataatgtccgtgccttcatgaacgtcaagcactggccctggatgaaactctttttcaagattaagcccctcctcaagagtgcagagaccgagaaagagatggccaccatgaaggaagaattccagaaaaccaaagatgaactcgccaagtcagaggcaaaacggaaggagctagaggaaaaaatggtcactctcttaaaagagaaaaatgacctgcaactccaggttcaatctgaagcagatagcttggctgatgcagaggaaaggtgtgagcaactgattaaaaacaaaatccaacttgaggccaaaatcaaagaggtgactgaaagagctgaggaggaggaagagatcaatgctgagctgacagccaagaagagaaaactggaggatgaatgttcagaactcaagaaagacattgatgaccttgagctgacactggccaaggttgagaaggagaaacatgccacggagaacaaggtgaaaaatcttacagaagagatggcaggcctggatgaaaccattgcaaaactgtccaaggagaagaaggctctccaagagacccaccagcagaccctggatgacctgcaggcagaggaggacaaagtcaacatcctgaccaaagctaaaaccaagctagaacagcaagtggatgatcttgaagggtctctggaacaagaaaagaagcttcgaatggatctagaaagagcaaagcggaaactggagggtgacctcaaattggcccaagaatccacaatggatatggaaaatgacaaacagcaacttgatgaaaagcttgaaaagaaagaatttgaaatcagcaatttgataagcaaaattgaagatgagcaagctgtagaaattcaactacagaagaagatcaaagagttgcaggcccgcattgaggagctgggggaagaaatcgaggcagagagggcgtcccgagccaaagcggagaagcagcgctctgacctctcccgggaactggaggagatcagcgagaggctggaagaagccggtggggcaacttctgctcaggtggaattgaacaagaagcgggaggctgagtttcagaaactgcgcagggacctggaggaggccaccctgcagcatgaagctatggtggctgctcttcggaagaagcacgcagacagtatggctgagcttggggagcagattgacaacttgcagcgggtcaaacagaagctggagaaggagaagagtgagctgaagatggagactgatgacctcagcagtaacgcagaggccatttccaaagccaagggaaaccttgaaaagatgtgccgctctctagaagatcaagtgagtgagcttaagaccaaggaagaggagcagcagcggctgatcaatgacctcacagcacagagagcgcgcctgcagacagaagcgggtgaatattctcgacaattagatgagaaagatgctttagtctctcagctttcaaggagcaagcaagcatctactcagcagattgaagagctgaaacatcaactagaggaagaaactaaagccaagaacgccctggcacacgccctgcagtcctcccgccatgactgcgacctgctgcgggaacagtatgaggaagagcaggaaggcaaagctgagctgcagagggcgctgtccaaggccaacagtgaggttgcccagtggagaaccaaatacgagacggatgccatccagcgcacagaggagctggaggaggccaagaaaaagttggcccagcgcctgcaagaagctgaggaacatgtagaagctgtgaacgccaaatgtgcttcccttgagaagacgaagcagcggctccagaatgaagttgaagacctcatgcttgatgtggaaaggtctaatgcagcctgtgcagcccttgataagaagcaaaggaactttgacaaggtcctatcagaatggaagcagaagtatgaggaaactcaggctgaacttgaggcctcccagaaggagtcacgttctcttagcactgagctgttcaaggtgaagaatgtctatgaggaatccctggatcaactcgaaacgctaagaagagaaaataagaacttgcaacaggagatttctgacctcactgagcagattgcagagggaggaaagcaaattcatgaattggagaaaataaagaagcaagtagaacaagagaaatgtgaaattcaggctgctttagaggaagcagaggcatctcttgaacatgaagaaggaaagattctgcgtatccagcttgagttaaaccaagtcaagtctgaagttgatagaaaaatcgcagaaaaggatgaggaaattgaccagctgaagagaaaccacactagagtcgtggagacaatgcagagcacgctggatgcagagattagaagcagaaatgatgctctgagagtcaagaagaaaatggaaggagatctgaatgaaatggaaatccagctgaaccatgccaatcgcttagctgcagagagtttaaggaactacaggaacacccaaggaatcctgaaggaaacccagctccacctggatgatgctctccggggccaggaggacctcaaggaacagctggcaattgtggagcgcagagccaacctgctgcaggctgagatcgaggagctgtgggccactctggaacagacagagagaagcaggaaaatcgccgaacaggagctcctggatgccagtgagcgtgtccagctcctccacacccagaataccagtctcattaacaccaagaagaaattagaaaatgacgtttcccaactccaaagtgaagtggaagaagtaatccaagaatcacgcaatgcagaagagaaagccaagaaggccatcactgatgctgccatgatggctgaggagctgaagaaggaacaggacaccagcgcccacctggagcggatgaagaagaacctggagcagacggtgaaggacctgcagcatcgtctagatgaggccgagcagctggcgctgaagggtgggaagaagcagatccagaaactggaggccagggtacgtgagcttgaaggagaggttgaaaatgaacagaaacgtaatgcagaggctgttaaaggtttacggaaacatgagcgacgagtaaaagaactcacctaccagactgaagaagatcgcaagaatgttctcaggctgcaggacttggtagataaattacaggcgaaggtgaaatcatacaagagacaagctgaggaggctgaggaacaatccaatgctaatctatctaaattccgcaaactccagcatgagctggaggaggccgaggaacgggctgacattgctgagtcccaggtcaacaaattgcgagtgaagagccgagaggttcacacaaaaatcagtgcagagtaaacacacctgcctgatgctatcaagaggctgaagaaaggcacaaaatgtgctatttttggtcacttgctttatgacgtttattttcctgttaaagctgaataaataaaaactacagtaaatgtatacattaaa

SEQ ID NO: 422542 - DNA, 5843 bp, Homo sapiens
  misc_feature (1351)..(1351): n is a, c, g, or t
gtggaacacttctgaacctgcatttttatctggaactccagaagcagaatcctttgctaaataaatcgcagccatgagtgcgagctcagacgctgagatggctgtttttggcgaagctgctccctaccttcgaaaatcagaaaaggagcggattgaggcccaaaacaagccgtttgatgctaaaacatctgtctttgtggcggagcccaaggaatcctatgtgaagagcactatacaaagcaaagaaggagggaaagtaaccgtaaagactgaaggtggagcaactctaactgtcagggaagaccaagtcttccctatgaaccctccgaaatatgacaaaattgaggacatggccatgatgactcatctacacgagcctggagtgctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgttgactgatcgagagaatcagtccatcctgatcaccggagaatctggtgccggaaagactgtgaacaccaagcgtgtcatccaatactttgcaacaattgcagttactggagagaagaagaaggatgaatctggcaaaatgcaggggactctggaagatcaaatcatcagcgccaatcccctactggaggcctttggcaatgccaaaaccgtgaggaatgacaactcctctcgctttggtaaattcattagaatccactttggtactacagggaagctggcatctgctgatatagaaacatatcttttagaaaagtccagagttactttccagctaaaggcggaaagaagctaccatattttttatcagatcacttccaataagaagccagatctaattgaaatgctcctgatcaccaccaacccatatgactatgccttcgtcagtcagggggagatcacagttcccagtattgatgaccaagaagagttgatggccactgatagtgccattgacatcctgggcttcactcctgaagagaaagtgtccatctataaactcacaggggctgtgatgcattatgggaacatgaaattcaagcaaaagcagcgtgaggagcaagctgagccagatggcacagaagtcgctgacaaggcagcctatctccagagtctgaactctgcagacctactcaaagccctctgctaccctagggtcaaggttggcaatgagtatgtcaccaaaggccagactgtgcagcaggtgtacaatgcngtgggtgctctggccaaagccgtctacgagaagatgttcctgtggatggtcacccgcatcaaccagcagctggacaccaagcagcccaggcagtacttcatcggggtcttggacattgctggctttgaaatctttgattttaacagcctggagcagctgtgcatcaacttcaccaacgagaaactgcaacagtttttcaaccaccacatgtttgtgctagagcaggaggagtacaagaaggaaggcatcgagtggacgttcattgactttgggatggacctggctgcctgcattgagctcattgagaagccactgggcatcttctccatcctggaagaggagtgcatgttccctaaggcaacggacacctccttcaagaacaagctgtatgaccagcacctgggcaagtctgccaacttccagaagcccaaggtggtcaaaggcaaggctgaggcccacttctctctgattcactatgctggcactgtggactacaacattactggctggctggacaaaaataaggaccccctgaatgatactgtggttgggctgtaccagaagtctgcaatgaagactctagccagtctcttttccacgtatgctagtgctgaagcagatagcagcgcgaagaaaggtgctaagaaaaagggctcttctttccagactgtgtctgcccttttcagggaaaatttaaataaattgatgacgaatctgaggagcacacaccctcacttcgtacggtgtatcattcccaatgaaaccaaaactcctggggcaatggaacatgaacttgtgttgcaccagctgaggtgtaatggtgtgctggaaggcatccgcatctgtaggaaaggattcccaagcagaatcttatatggtgatttcaaacaaagatacaaggttttaaatgcaagtgctattccagagggacagttcattgacagcaagaaggcttctgagaaacttcttgcatctattgatattgatcatactcaatataaatttggacataccaaggttttcttcaaagctggacttctgggtcttctggaagaaatgagagatgaaaaattagcccaaattataacaagaacacaagctgtctgtaggggattcctaatgagggtagaatatcagaagatgttgcaaaggagagaagcacttttctgcatccagtataatgtccgtgccttcatgaacgtcaagcactggccctggatgaaactctttttcaagattaagcccctcctcaagagtgcagagaccgagaaagagatggccaccatgaaggaagaattccagaaaaccaaagatgaactcgccaagtcagaggcaaaacggaaggagctagaggaaaaaatggtcactctcttaaaagagaaaaatgacctgcaactccaggttcaatctgaagcagatagcttggctgatgcagaggaaaggtgtgagcaactgattaaaaacaaaatccaacttgaggccaaaatcaaagaggtgactgaaagagctgaggaggaggaagagatcaatgctgagctgacagccaagaagagaaaactggaggatgaatgttcagaactcaagaaagacattgatgaccttgagctgacactggccaaggttgagaaggagaaacatgccacggagaacaaggtgaaaaatcttacagaagagatggcaggcctggatgaaaccattgcaaaactgtccaaggagaagaaggctctccaagagacccaccagcagaccctggatgacctgcaggcagaggaggacaaagtcaacatcctgaccaaagctaaaaccaagctagaacagcaagtggatgatcttgaagggtctctggaacaagaaaagaagcttcgaatggatctagaaagagcaaagcggaaactggagggtgacctcaaattggcccaagaatccacaatggatatggaaaatgacaaacagcaacttgatgaaaagcttgaaaagaaagaatttgaaatcagcaatttgataagcaaaattgaagatgagcaagctgtagaaattcaactacagaagaagatcaaagagttgcaggcccgcattgaggagctgggggaagaaatcgaggcagagagggcgtcccgagccaaagcggagaagcagcgctctgacctctcccgggaactggaggagatcagcgagaggctggaagaagccggtggggcaacttctgctcaggtggaattgaacaagaagcgggaggctgagtttcagaaactgcgcagggacctggaggaggccaccctgcagcatgaagctatggtggctgctcttcggaagaagcacgcagacagtatggctgagcttggggagcagattgacaacttgcagcgggtcaaacagaagctggagaaggagaagagtgagctgaagatggagactgatgacctcagcagtaacgcagaggccatttccaaagccaagggaaaccttgaaaagatgtgccgctctctagaagatcaagtgagtgagcttaagaccaaggaagaggagcagcagcggctgatcaatgacctcacagcacagagagcgcgcctgcagacagaagcgggtgaatattctcgacaattagatgagaaagatgctttagtctctcagctttcaaggagcaagcaagcatctactcagcagattgaagagctgaaacatcaactagaggaagaaactaaagccaagaacgccctggcacacgccctgcagtcctcccgccatgactgcgacctgctgcgggaacagtatgaggaagagcaggaaggcaaagctgagctgcagagggcgctgtccaaggccaacagtgaggttgcccagtggagaaccaaatacgagacggatgccatccagcgcacagaggagctggaggaggccaagaaaaagttggcccagcgcctgcaagaagctgaggaacatgtagaagctgtgaacgccaaatgtgcttcccttgagaagacgaagcagcggctccagaatgaagttgaagacctcatgcttgatgtggaaaggtctaatgcagcctgtgcagcccttgataagaagcaaaggaactttgacaaggtcctatcagaatggaagcagaagtatgaggaaactcaggctgaacttgaggcctcccagaaggagtcacgttctcttagcactgagctgttcaaggtgaagaatgtctatgaggaatccctggatcaactcgaaacgctaagaagagaaaataagaacttgcaacaggagatttctgacctcactgagcagattgcagagggaggaaagcaaattcatgaattggagaaaataaagaagcaagtagaacaagagaaatgtgaaattcaggctgctttagaggaagcagaggcatctcttgaacatgaagaaggaaagattctgcgtatccagcttgagttaaaccaagtcaagtctgaagttgatagaaaaatcgcagaaaaggatgaggaaattgaccagctgaagagaaaccacactagagtcgtggagacaatgcagagcacgctggatgcagagattagaagcagaaatgatgctctgagagtcaagaagaaaatggaaggagatctgaatgaaatggaaatccagctgaaccatgccaatcgcttagctgcagagagtttaaggaactacaggaacacccaaggaatcctgaaggaaacccagctccacctggatgatgctctccggggccaggaggacctcaaggaacagctggcaattgtggagcgcagagccaacctgctgcaggctgagatcgaggagctgtgggccactctggaacagacagagagaagcaggaaaatcgccgaacaggagctcctggatgccagtgagcgtgtccagctcctccacacccagaataccagtctcattaacaccaagaagaaattagaaaatgacgtttcccaactccaaagtgaagtggaagaagtaatccaagaatcacgcaatgcagaagagaaagccaagaaggccatcactgatgctgccatgatggctgaggagctgaagaaggaacaggacaccagcgcccacctggagcggatgaagaagaacctggagcagacggtgaaggacctgcagcatcgtctagatgaggccgagcagctggcgctgaagggtgggaagaagcagatccagaaactggaggccagggtacgtgagcttgaaggagaggttgaaaatgaacagaaacgtaatgcagaggctgttaaaggtttacggaaacatgagcgacgagtaaaagaactcacctaccagactgaagaagatcgcaagaatgttctcaggctgcaggacttggtagataaattacaggcgaaggtgaaatcatacaagagacaagctgaggaggctgagggaacaatcccaatgcctaatttaattctaaatttccgcaaaacttccaagcatggagcctgggaggtagtgcccttggtaacctggttctgacaatttggtt

SEQ ID NO: 422543 - DNA, 609 bp, Homo sapiens
cagccatgagtgcgagctcagacgctgagatggctgtttttggcgaagctgctccctaccttcgaaaatcagaaaaggagcggattgaggcccaaaacaagccgtttgatgctaaaacatctgtctttgtggcggagcccaaggaatcctatgtgaagagcactatacaaagcaaagaaggagggaaagtaaccgtaaagactgaaggtggagcagtaagtgaaaacagggagaaaatactccccattttatttcttggttcaaaagttgaagcctaacttactgggaatctccaagcctgttgccaatgcaaacacccttctagtcagtgttgagacattagatgtggaaggcaaaagaaattcacagcagtaccttcatgtcttcccttcccaacttcgcacaggacctcaccccactatgtatggccttcaccatttcccttcaattccccacttcctagtctgaatgtccaaacttgagggaaatgaaaacaagctcctcctatcagaagttaaatatttacttagttaaataatgtattaatatccccattacttccaaaaacatgaagtttcttaatgaatgaaagaaaaaaataaaaattta

SEQ ID NO: 422544 - DNA, 3997 bp, Homo sapiens
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggttcctgtaaccagcacagtgcctgattcatgaattaaagaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggagcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaggcttgcctggactacagaccata

SEQ ID NO: 422545 - DNA, 3872 bp, Homo sapiens
  misc_feature (3215)..(3215): n is a, c, g, or t
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggagcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatgaggtgggcagatcacaaggtcaggagtttgagaccagcctgancaaaatggtgaaaccctgtctctactaaaaaaaagaaaaatcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaggcttgcctggactacagaccata

SEQ ID NO: 422546 - DNA, 3648 bp, Homo sapiens
  misc_feature (3215)..(3215): n is a, c, g, or t
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggagcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatgaggtgggcagatcacaaggtcaggagtttgagaccagcctgancaaaatggtgaaaccctgtctctactaaaaaaaagaaaaatcaggccgacgtggtggcgatgcgcctggtgaaccccagctactccaggaagctgaggcgagagaatcggttgaacccggaggcaacggtgcagggacgtgagatccaacaatgcactccagcctggcgacagagagagactccatctcaaacaatacacaagaaagaggggcgacaaaaactatccccgaggggccacgtaagcggacccattcctgtgccaaggggcgcaaaaaaagagagacatatacaccaagacagccgccagttacaacgatgtacgggcgaaagcacacgcgactatgagagagccacacgggggggcaaagccgcaaccaagcgaagaacacgagacaaccgagaagaggtcacgccacgcagcgagtcaggtaa

SEQ ID NO: 422547 - DNA, 3208 bp, Homo sapiens
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaggcttgcctggactacagaccata

SEQ ID NO: 422548 - DNA, 2729 bp, Homo sapiens
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgcactccagcctggcgacagagagagactccatctcaaacaatacacaagaaagaggggcgacaaaaactatccccgaggggccacgtaagcggacccattcctgtgccaaggggcgcaaaaaaagagagacatatacaccaagacagccgccagttacaacgatgtacgggcgaaagcacacgcgactatgagagagccacacgggggggcaaagccgcaaccaagcgaagaacacgagacaaccgagaagaggtcacgccacgcagcgagtcaggtaa

SEQ ID NO: 422549 - DNA, 650 bp, Homo sapiens
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaaggtatgtgctgcttataaataaaatggacagctgttttctagcaca

SEQ ID NO: 422550 - DNA, 684 bp, Homo sapiens
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagtatacagctggtataataatgcagtgtttacggtgcgctcggccggccggcgggggtgggggatggtggggtggtggtg

SEQ ID NO: 422551 - DNA, 576 bp, Homo sapiens
gtccttttcacaattatctctttgctagacagcctgaagggcctaattttggcctaattattgagtgtaggaaagttaagattttcaaaattccaggtgcactgttcacatcaatttccggtaacactaatgaaattcactagaaattacaattttaaagagtgtaatctcaacagtgttacttatactttaatttacgaatattgtatttagccatgttgcacctttaagtaaaaccaaatcacatatttgggaaaatctggcaccctttgcattgaacttaatgtaaaatataatacattgaagaatgtatgttctgggtctataaatactggatattaaggtcagcactatttaaaacatcttatgcaggcagaagcactggtaaaacctgttatttttgttatatgtagtgattatagaagaatagggttcactttattctaataattaaaagattatagaaagttctgaaaaaataattgcctgtaagcccacctgcttaatatattgcttattttcatactgtcttccttttgctattctcgtaatttgaaatctgtttttcaaaactag

SEQ ID NO: 422552 - DNA, 815 bp, Homo sapiens
ctagccttaaatttcatttttaaagagggcttagggtgagttttgtatttgtcctgtttattagtgagctggagattactagataaaagtatatttgactctaagtaaaaatgctttggtgatttaaatgcttatcaacttacatgaatgcagtgggaaaagccataatctaaacctgtttctaaggaaacttaagttttataacattaattcatattgttactagaatcaatttttattaataaatgctatctcctcaccctaccccctttttaaatttcaggttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatc

SEQ ID NO: 422553 - DNA, 3958 bp, Homo sapiens
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggagcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaggcttgcctggactacagaccata

SEQ ID NO: 422554 - DNA, 3945 bp, Homo sapiens
  misc_feature (3288)..(3288): n is a, c, g, or t
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggagcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacagtggctcacgcctgtaatcccagcactttgggaggctgaggtgggcagatcacaaggtcaggagtttgagaccagcctgancaaaatggtgaaaccctgtctctactaaaaaaaagaaaaatcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaggcttgcctggactacagaccata

SEQ ID NO: 422555 - DNA, 3087 bp, Homo sapiens
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaggcttgcctggactacagaccata

SEQ ID NO: 422556 - DNA, 2173 bp, Homo sapiens
gtcttcgtgtatgctgtctgcgtctggtttctgttttgttctagcgttatttaattgctggtgtgcttgcgtctttgctgcgcgctgctctgtgcggttatatttgggttgtcgtgtggagcgtcgtagctagtgtctgtgtgtgtttgttttttgcgtcgatttgtctgtgggtgtgcggatgatggtgttggtttctttatctgttggacctgtagatggggtgtgcgagggggtgggcgactgctgcggtgacgatgaggatggcctggctggttcgcgcgtctgatggtcggtgcgttgtgccggtgtggttggtcgtaagatgggggtctctagcgttcgcgaggtgcttgaggtggcgggtgtgtatgtgagttgtgcgtgctgtgccgcggtggtgcgagcttgtgttctgcgtctggaggttttatgacctggttgggcgatgtgggtgtgagcgccggcaggggtgtatgtgtgagccaggtgtgtggcacaactgcggcaggttgccaggttaactggggaggctgagtcaggagggatggcttgaacccatggaactggaggatgcagtgaggctatgatcacaccactggactccagcctgggtgatggagtgggacagtgtctcgtttaaagagatgtggggccaggtgcagtggctcacgcctgtaatcccagcactttgggaggctgaggtgggcagatcacaaggtcaggagtttgagaccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggagcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaggcttgcctggactacagaccata

SEQ ID NO: 422557 - DNA, 1183 bp, Homo sapiens
ggcctgggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtataggagaatggcggcatcggttggcctttagtactgggggggtttccgcgtgctt

SEQ ID NO: 422558 - DNA, 552 bp, Homo sapiens
  misc_feature (55)..(55): n is a, c, g, or t
gacatagtcaatgaatagtcagtagaattagaatggtgaacggattggcgacatntcaagagaagattgtcatgcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaaatggtcgccaatccggggaacctctagag

SEQ ID NO: 422559 - DNA, 3291 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422560 - DNA, 3133 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgatagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422561 - DNA, 3158 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgatagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422562 - DNA, 4475 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttcagaagcttccctgcaagtagatatcgagagagcacactttccattagagcctggtaatacccatatcacctctgctctgaggctgggcctgcagctgtgtagtctttggaagaggtagcccctgaacgcagagcctaagagaagcaagtcggccctgacgccaggccccagtgggcgcctcacactcagaacctcataccccagagcaaaccgatggtcagggagagggctagagctcacacccagctcggaatagatcttccctgatgacatttcatgccctctaaggcagtttttaaatgaaggtacacacatccaggggtgttcacaggctttcacagcaagggtacctatttcatggcaaaataggcagttttaaaagaataaacaagctaggtgtggtggctcatgcctgtaatcctagcactttgggaagccaaagctgatggatcgcttgagcccaggagtttgagaccagcctgggcaacatggcaaaaccccatctctacaaaaaatacaaaaagtaggccgggcacggtggttcacacctgtaatcccggcattttgggaggccgagataggtggatcacctgaagtcaggtgtttgagaccagcctggccaacatggtggaacccaatctctactaaaaatacaaaaaaactagccggatatggtggcgggtgcctgtaatctcagctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttc

SEQ ID NO: 422563 - DNA, 3110 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgatagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422564 - DNA, 2555 bp, Homo sapiens
ctgtggtggacttctcaggcagaggctcagaaggaaatgctgtgaggatgtttagcttgttgggaggtcaacttagtaggtcatgtccacagcgtattggtcttgctcttgttctaaggaaatgatgttagaatgtttagctcgctgggaggtcaacttagtaggtcacgtccacagcatgttggtcttgctcttgctgtaagagtaaaactctctttcctactgtgttttataggagaccataacagccaaggtctagtcagcctcaaacctctggtttgggggaagaagtcccctcctttataatgggggtctctccacagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422565 - DNA, 4515 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttcagaagcttccctgcaagtagatatcgagagagcacactttccattagagcctggtaatacccatatcacctctgctctgaggctgggcctgcagctgtgtagtctttggaagaggtagcccctgaacgcagagcctaagagaagcaagtcggccctgacgccaggccccagtgggcgcctcacactcagaacctcataccccagagcaaaccgatggtcagggagagggctagagctcacacccagctcggaatagatcttccctgatgacatttcatgccctctaaggcagtttttaaatgaaggtacacacatccaggggtgttcacaggctttcacagcaagggtacctatttcatggcaaaataggcagttttaaaagaataaacaagctaggtgtggtggctcatgcctgtaatcctagcactttgggaagccaaaatggtggaacccaatctctactaaaaatacaaaaaaactagccggatatggtggcgggtgcctgtaatctcagctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttcagatccttggcttctgtgttctcattcctcaaattgatctacctagtgtgaaactcccgtgccagatctcctttcccatccacgcttttcattccccgtctgccaagtgataaagttacctaaggtgctacccatctcacccagaacctgtgttacttccagggcaccaaattaagagagaaattcaaattgttagtatccttatagcttcattagatcaaag

SEQ ID NO: 422566 - DNA, 2081 bp, Homo sapiens
gaaaattgtagaaatttagaggatggtggaatggttgaaagacgggattgcactcacagccaaaagggaagaatgactgttctgatattccagctctgttaggattctgctgattgggacactccttatcctgagcacccctcaccctcactttctctctccttccctagcttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422567 - DNA, 3388 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcggtgaggttgcaagggttgagggtgctggcacatgtctggggcttggacttgggtgggggcagcacatcctgactgcttgccaccctctgccctgcagtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422568 - DNA, 3245 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422569 - DNA, 3267 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtagcaagcactgcgccgccttcagcgtctcggcggcgtacgctgcctggatcagactgtctgggggaagcg

SEQ ID NO: 422570 - DNA, 1578 bp, Homo sapiens
  misc_feature (24)..(25): n is a, c, g, or t
cccgggctgcaggaattggcacgnngaagtactatgaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422571 - DNA, 2908 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagcctgtctgtctctctctctcactctctgttgggaggctgaagagtatgacccatagcagtggagctagactttaggtagggttattattttgatcttaaaagcatcctttgcaaaataagcaacaaaaattcataattacttgtcaaagctacaaactaatggcttatgtcaagtcctgttaatctcggcttgggatggcctcctccctgcctgagaag

SEQ ID NO: 422572 - DNA, 1455 bp, Homo sapiens
aaggagcctaaggcagtgctgtccctagagagacactcacagtcccatgacaaaagaaagatgcaccctgtccagataaggtgcagcaggtgcacacacccccagacagctcattgttcacttttgtggtgccttccatatcttataagggccagacatacccacaccactaaaccataccctcaacccaaggtatggaaaggaacagggatagaagcagaaataacacagtcttctggtgtgggctttgctcccatgggaacatgggaagttgcctgagaggcaggtcagtggtgctactcatggggaggtgagggatagtttagatgtcttgtggtggtccctctccactcttgcctgtcctggacagtgtacgaccttctaagtggccacattgtgaagaagctgaccaaccacaaggcctgtgtgcgtgacgtcagttggcacccctttgaagagaagattgtcagcagttcggtgaggttgcaagggttgagggtgctggcacatgtctggggcttggacttgggtgggggcagcacatcctgactgcttgccaccctctgccctgcagtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422573 - DNA, 2584 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctactgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422574 - DNA, 2938 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttggtaaggattgtgtcagaacagggggcctcaggaagggcaggaatgactccttgccattccacctataacgactagtgaccaccttaaaaagcccagtgacagctacaggtaaaatcaaacttagcttggaggcttaaacagagaaatagaaaccattctatttttcagtgttttaaattaagaaaaggaacatagaattctagacagtaaatataatagattgccaaaaatatagttggttctgtttttcagccagtcaagaaagaggttgcagatgaaaggtaggagggaacagagacaaaatgacacaggaagatggtagcaagtagttaagggacatgcagtcgctaaagcagaaaagcatagaaagaaataagctggctgcagtggctcatgcctgtaaccccagggctttgggaggccaatgagggcagatcacttgagcccaggagtttgagaccagccagggcaacatggagaaaccttgtctctacaaaaaatggctggacatggtggcacaggcctgtagtcccagctacttgggaggctagggtgggagaatcacctgagcccgagactgcagtgagccatgattgtgccaccgcacttcagcctgggtgacagagtgagaaact

SEQ ID NO: 422575 - DNA, 656 bp, Homo sapiens
  misc_feature (42)..(42): n is a, c, g, or t
tcacactgccccatggggagaatcttccaggctcagctgagncacgtaaggagaccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422576 - DNA, 2346 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaaggtgggccagaagtcaggactgtacagccaggccgctaaggttctagttgcccaggagggcatgaaagcggactggtgtgggaatttgacaagctccttattaaccaaggtttgtaagagttggagtttagggaaggggctcaagccagggaacatgaattccatctgtactcaccagtcctcaaggagcagggcagggctttccgtacaagaaaaatggaagaccggtcaggtacagcggctcacacctgtaatcctagcactttgggaggctgaggtgggaggatcacttgagctcaggcgttccagaccagcctgtgaaacctagcgagacctcatctctatttattt

SEQ ID NO: 422577 - DNA, 1941 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggagggtaagtgcttgtggggtatgtttccctcaataacaagatgggggttctgccagagatgagttctgctgttacacagatggcactggcagctgcagagaacaaccagaccttctcccaaggtcaggatttacaagttgcttcaccccttgctctccatttccccagcacgagattggaggtgtcaagcct

SEQ ID NO: 422578 - DNA, 1358 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccggagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422579 - DNA, 1460 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcagtgagtatggggcttggtgaagagactctaagggccagataggtcttatctcctaaactttgaaggggtaggtgttaaag

SEQ ID NO: 422580 - DNA, 1371 bp, Homo sapiens
  misc_feature (1325)..(1325): n is a, c, g, or t
  misc_feature (1327)..(1327): n is a, c, g, or t
  misc_feature (1333)..(1333): n is a, c, g, or t
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgatagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagancnaaatcngatctttaggcgaaggcggcgaattcaagctcagcgga

SEQ ID NO: 422581 - DNA, 1178 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctgaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaaccaaaaatcgatctataatgcgaaataggcggtccataattcagagcttaaggccggaagtagcgaacgttggatttgcctacccgagggaacctcctactccgtcgggtatctgttgcattcggggggggccaccgccgctccaaaacgctggttccgtcctcaggaaaaaggcccggttttcaacacccaacagcaaaggcgtacccggcacagggcacgcgcggcctgcccctcagcccgct

SEQ ID NO: 422582 - DNA, 322 bp, Homo sapiens
taaggctagaataggaaagccggccagtagcctgggcaaggaaaggaaaacctagccaggtggtaggatctgaggcagaacgctggaaatgagttcacctggatgaagagaggcaagtaaagccagaggccagagttcttctgctcaactagagaacgggaactagactgacaggcgccgacatttgcaagctctgatgcttcactatccacctttggattcatagggtgatgcccggtatctgatctccaactctaaagaccagaccatcaaactctgggatatccgacgcttttccagccgggaaggcatggaagcttca

SEQ ID NO: 422583 - DNA, 398 bp, Homo sapiens
tcaagggaagctctttgggagcaaacctcttgagttggaagttctgtttaggggaaaaagtatactggtgggtctgtgtgcattcctgggagggaagcaccatcttgtcagccagaggactgggtaaaatagatggttgcaggatgatttctgggttctcactgagcatctgcattatggtgcatgttagccagacttcttttttcccctggggatgtgccttacaaccgttgtcagattttatgtagattaacaaaagctgaaggaagtccacttaacccagctccttcttgcttttaggccagatgagcgtcgctttgctgtcttctccattgctgtctcctcagatggacgagaagtactaggagggtaagtgcttgtggggtatgtttccctca

SEQ ID NO: 422584 - DNA, 2669 bp, Homo sapiens
atctttcttcagttggtgagctagggtagcgcactacggttcactcttgctttctttgcttcacaggatgattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422585 - DNA, 2764 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctgaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422586 - DNA, 3236 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422587 - DNA, 2766 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctgagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcac

SEQ ID NO: 422588 - DNA, 4698 bp, Homo sapiens
gattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttcagaagcttccctgcaagtagatatcgagagagcacactttccattagagcctggtaatacccatatcacctctgctctgaggctgggcctgcagctgtgtagtctttggaagaggtagcccctgaacgcagagcctaagagaagcaagtcggccctgacgccaggccccagtgggcgcctcacactcagaacctcataccccagagcaaaccgatggtcagggagagggctagagctcacacccagctcggaatagatcttccctgatgacatttcatgccctctaaggcagtttttaaatgaaggtacacacatccaggggtgttcacaggctttcacagcaagggtacctatttcatggcaaaataggcagttttaaaagaataaacaagctaggtgtggtggctcatgcctgtaatcctagcactttgggaagccaaagctgatggatcgcttgagcccaggagtttgagaccagcctgggcaacatggcaaaaccccatctctacaaaaaatacaaaaagtaggccgggcacggtggttcacacctgtaatcccggcattttgggaggccgagataggtggatcacctgaagtcaggtgtttgagaccagcctggccaacatggtggaacccaatctctactaaaaatacaaaaaaactagccggatatggtggcgggtgcctgtaatctcagctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttcagatccttggcttctgtgttctcattcctcaaattgatctacctagtgtgaaactcccgtgccagatctcctttcccatccacgcttttcattccccgtctgccaagtgataaagttacctaaggtgctacccatctcacccagaacctgtgttacttccagggcaccaaattaagagagaaattcaaattgttagtatccttatagcttcattagatcaaag

SEQ ID NO: 422589 - DNA, 407 bp, Homo sapiens
ggagactgtccactgactattaggtggagaaagagccaccacttgaagattggaaaggcatttgtctctgggcatcgaaccttgctcaggactggtggtacgaaacaatcccaaagcagatttcctaacctagggtttactctgcatccctacccagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttggtaaggattgtgtcagaacagggggcctcaggaagggcaggaatgactccttgccattccacctataacgactagtgaccaccttaaaaagcccagt

SEQ ID NO: 422590 - DNA, 1025 bp, Homo sapiens
gcccaaggcaagagtgcagatgtaccacaggcctcatccttaattgttatacttcaagctaacaaacaattaagtacaatatgtcctatcagctgatcttgacaagtataccttcgtggccactgggaaggccagtttgatgtagaatccctgcctcctgggggttctgcaggttgggttccctggaccacccaattccctttccatccctggctctgtgttgtacctcaggagcttcctacatttgtgggacattcctggccatacctccaaggtccacctgcatgccccttggccattctttgggcctagaggtgcacacagctgtgtggccaccttccagaagacggacctgggaaaacagacttgaaattctctaagcagagaatctggggctccgggtatccaaagaatggtctagaggtgggaacacaggctcttgccttgcttctgcagactacttgcggtggtagacatgtatgtggtcagaggaggacccaagcaggctctctaaggctgaggccagctcaggagcccctcagtgcgcatgtctaaggcgtaactgcagaaaggaagaaagacttggggaggagattaaggcagagtcattaagactgcctagttcattttggggggaagaggataagttgggaagagttaaacaagaggaaaaagaggctgatgaaaagaagggagaagcccagaacctgcaccacttctacaaagatagggactcctaatttattattgtgtttagttagagaatgaaaaaaaaaaaaaacaaaaaaaaaaccttttacagaggtcaaagggctctgtaattcagggacaagggatatgaaaggcaaaagaaggatggttttggagctaaaagcagggactaggaatgatttctccccaaggtcacctggatccatcttatttctgcaccttcccctctttcatgatggatactggacccctgaaccattcaagaagaaacattccaccttattgtatcccctaaaagggggttcttttagagt

SEQ ID NO: 422591 - DNA, 901 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaatgggccacttgggtggaagggtgcttaaattaaaagggggggttcctctgggccccatttgttcttaccgggcgtctacttggagcttttttggggtttatttaaaggttgggttggagaggggagtgtcaattggcgtgggggcttggggtccaatgttg

SEQ ID NO: 422592 - DNA, 773 bp, Homo sapiens
gcgtcccatgtccaggggtctccacgtctcgtcctgtggggctcccctctgtcgcgcggccgcgtgtgtgtgtcctcgctcctaattcgggccgaatatactccctgtatcccaagaggtatatataccgccccttttgggctgggaatcctgggtactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaa

SEQ ID NO: 422593 - DNA, 4570 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaa

SEQ ID NO: 422594 - DNA, 4513 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctctttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaa

SEQ ID NO: 422595 - DNA, 4613 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaaaaaaaaaaacaaaaggggggcggtctaaaagtttccttgaggc

SEQ ID NO: 422596 - DNA, 4516 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgatatatcatcactgaagacaggaagataggcacacagattcttcctcgtagtaattcatagtgcactaggtgaaagagatgaagtatgtattaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaa

SEQ ID NO: 422597 - DNA, 5162 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaaagagcctcctacttttgtcttattgtcagatatgtgaaagcagtttttagaggttagaaaatggaaatttccacctttctagtaggatgagaatagagaaatgttctatttttttttttcctacctgcatttgcattcatggatggccaggattcgttttggggtattatttttattgttgttttgcatcctactagctattggatctactatattgctgttatcattgagtatgctttgaagagccttaaatgactccagcagtttgctttgggtgtgaagtctttaattttcccagagatggtggaaatccgattctgagtgaaagtgacagttatcaattactgagttattttcaaccttgtcctcaactgggagccttcagatgcccaaacattctggcaagtaactattattttctgtctaaaatctgtttgtgagcatagtccatcagtcagattattcagccaatttatactattattagtatttactgagaaatatgaaaaggcttttgtcttgctttgaggaatgtggtcttcctgctgttagcttcccaaaactgaataaacacagaccaacctttgtcaga

SEQ ID NO: 422598 - DNA, 4961 bp, Homo sapiens
  misc_feature (4958)..(4958): n is a, c, g, or t
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaagaaaacaaaacacaacaaaaacaaaaacaaaaaacctcttttgggagccgccttgggcccccggaaaaacgcttttctaaaaccctttgcttggggcgcgcgcggggccccaagtatgtgttagacgtgtgaacacgtgtggtccatagaggtgttcccccagaggaagaactcggggccaatagcacatgagggcttgggattctcctcccgcatttaaaagaaagcgcccgggggggaaaaccagaaagtggttttgttgaacaaacaattcccccaagtggaggatcttcggagaagacccatagaggggaactcttttcacgaggaggatctccacaggaagagcctccgaaatatcataattagccccggcgttggggagggngtg

SEQ ID NO: 422599 - DNA, 3590 bp, Homo sapiens
  misc_feature (3539)..(3539): n is a, c, g, or t
  misc_feature (3555)..(3555): n is a, c, g, or t
  misc_feature (3557)..(3557): n is a, c, g, or t
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtattgnttgttaagaagaatgncnggtccagtagggggtgcttcacgaggacccttt

SEQ ID NO: 422600 - DNA, 1120 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctata

SEQ ID NO: 422601 - DNA, 1172 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctataaaaacagaacacaccgcacaaataacacaacacaacgccccgcccgcacccc

SEQ ID NO: 422602 - DNA, 941 bp, Homo sapiens
  misc_feature (798)..(798): n is a, c, g, or t
  misc_feature (801)..(801): n is a, c, g, or t
  misc_feature (803)..(804): n is a, c, g, or t
  misc_feature (806)..(806): n is a, c, g, or t
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaaaaaaaaaaaaaaaacaaaaaccctcgagttttttntcntnntncttatattattttttttttttttttagaatttatataaatttattaatttatttttaggtgggggaaacatccgaaaaaaagtaaacttgcccagcacttcataggtgtattttgggtttttatccaatttcatt

SEQ ID NO: 422603 - DNA, 4460 bp, Homo sapiens
gccgtgacaagcccaaccggacggctggagagggcgagaagggcagacgggacatgcagcctcttccgcctgagccccggaagggtgatgtggctgcggcatcgccggcctcgctatgattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaa

SEQ ID NO: 422604 - DNA, 4417 bp, Homo sapiens
gccttttggagacagattcgcagtggtcgcttcttctccttggatttgttaaggattccaagtaactcttatttgattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaa

SEQ ID NO: 422605 - DNA, 629 bp, Homo sapiens
  misc_feature (510)..(511): n is a, c, g, or t
  misc_feature (613)..(614): n is a, c, g, or t
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaaatnntaagatgctccccccatcctcacccccccctgccccaccaatccacaccctcaagtaacgtgttcacctaccatattattcaccattcctgccaaaatggtnntattcctggttggta

SEQ ID NO: 422606 - DNA, 286 bp, Homo sapiens
gccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttgtagcgtggccagaaggaggggatcctcaagagtcaccgga

SEQ ID NO: 422607 - DNA, 3664 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 422608 - DNA, 4069 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgtggatttgtcttaagcgtttgtacggcagaaagaaaggtgttgaaaccagtatagcagtgcctcaaaaaattaaacagaattaccatatgatctagcaattcctcttttggatccagaagcggatccaaaagaatggaaaacaggatctcgaacggatatctgtacacccatattcacagcagcattattcgcaataaccaaaaggtagaagcaacccaagtgtccatcagtgggtaaatggacacaggaaatgtgttttgtccgtacagtggactgttatacagccttcaaaaggaaggacattctgtcctatgctacaacatgggtgaacctaaaggacattgtgctacgtgaaagaagcctgtcacaaaaggacaaatactgtctgattccatatatatgagctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 422609 - DNA, 2767 bp, Homo sapiens
gatgcttatactaataatgacctgtgctgttcccactcagttgctctctgttttcgagaagacatgagaagctgcaacatgacctggagtggaactggagagtcacatttttgtttcagccacctgctgggcagcagagcgactgcaccttcccagaaggctgaagtgctcgtgtgctgcactccagtggcatctctgcagtggtcagagtgacctggtataagggagagggcatcaccttgccccctgtgctgactcctgccctccccctacaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 422610 - DNA, 2519 bp, Homo sapiens
cttatatagaggacgcacatttgcgatgagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 422611 - DNA, 3262 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggccaatgggagagtaatgcctgtcatttccaggggaagcagaaaaaggacagtaacaactttactaccatagccccttttccagagcaagggatcctctagatcc

SEQ ID NO: 422612 - DNA, 2521 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 422613 - DNA, 1152 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaacttcagctgtttcccgctactgctaagaacaatctcagaataccattccattatcatgtgctccctccatctgtgtcttcagaaatcaaagcgacgaaaccaaatattggccatgatttgctgcttcctccctgaactaaaatgaattatagcaaa

SEQ ID NO: 422614 - DNA, 715 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcggtgagtcgacccccgggaccccctcccccagcgccgacagc

SEQ ID NO: 422615 - DNA, 3664 bp, Homo sapiens
  misc_feature (386)..(386): n is a, c, g, or t
  misc_feature (399)..(399): n is a, c, g, or t
  misc_feature (409)..(409): n is a, c, g, or t
  misc_feature (413)..(413): n is a, c, g, or t
  misc_feature (427)..(427): n is a, c, g, or t
  misc_feature (505)..(505): n is a, c, g, or t
  misc_feature (514)..(514): n is a, c, g, or t
  misc_feature (560)..(560): n is a, c, g, or t
  misc_feature (563)..(563): n is a, c, g, or t
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttaaanaaggaaaaaaganaaaaggtganaagnaaaggtaattaaanaaaaaagaaaggaaaggaggtgcgaaaaaattattaggcttagggaaaaaagtggaagtggaaaaaattataaaaaangaaaaaaanaaaaaaagggacgaaaaaaaaaaggaggaagggaaaaaaaaaaaanaantaatattataaaaaggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 422616 - DNA, 3601 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgtttta

SEQ ID NO: 422617 - DNA, 2437 bp, Homo sapiens
tacccggccaggaagagccggatcgggatggactctcctcgcactggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 422618 - DNA, 3082 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtaggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcatttcgggtagcctaggagggcctcggcagaagactgctgccacaccttccgaatcattctgcttgccaaataggtcatcttcaccagttgagc

SEQ ID NO: 422619 - DNA, 1485 bp, Homo sapiens
ggccgccggaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacggtaagtgatgtctgctggttccccactgtaccctagaacctgccccatgtggacaaggacctgaggccgtccccactttgaggatcttcacagggatcccgagaaggaagagtgtcgcgagctgtggcgtgctggtaaaccattaaccgtgggccttctaggaggaaagtggccctaggttgtagcatgtgtcaatttctgtagtgtacatagccccgccatggccaatttcaagctacctaatgttcctaaatgtagaggtgggagagatgtgctattaccatcatatggagacacattccctcaagagcagagagcattgtaaagggccggaaaataggaagtgatgagattttcgcatgtcttacctttgtttttaacatgattcatttaattgtgagtttatataatttaactttaaataattgctgtgtttaacagccaggtcataaaattcctgaaagttcaacgtcagccacccccagcacactcctgctggctgggtgtcaggagatcctgacctgctgtccggctctgccacacagctgcagtgtgaccttgagctctgtaactcagctttctcacttcaaagtgggtaatggacttggattctaattctagatgtcctcttcttttgggggtgataagaaaata

SEQ ID NO: 422620 - DNA, 4837 bp, Homo sapiens
agcgtcgtttctaggcaaccgcagactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaga

SEQ ID NO: 422621 - DNA, 490 bp, Homo sapiens
gggcgtctagaggctccctcctgcgttcagtggtagtcttgctgccagtcggggaacgtggctgacccctcctccaggtagacctctgaaatatggatgtgtctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaga

SEQ ID NO: 422622 - DNA, 450 bp, Homo sapiens
aagtttttagagggcatgatcaagagcagctcatctgctgtgaggatggatgtgggattcttggtttgctagttctgctgatagagagagacttaagggaagggaaagaatgactgatggaatattttttctctctgtagaacttcctgcagggactgctcaccaaagacccacggcagcgactgtcctggccagacctcttatatcacccctttattgctggtcatgtcaccagtgagtcatcagggttcccagggctcttggacttcccagtacttcctctaaactacttccctttcacttccccgaccatctagatataacatgtcgtctttcctccagcagcttgaactttcttcctagcccttcacttaacctttgccacttcccttacaacccactctctctctgtcactttttcaaaatgatcttctgcccacagaagcctgg

SEQ ID NO: 422623 - DNA, 635 bp, Homo sapiens
  misc_feature (19)..(19): n is a, c, g, or t
  misc_feature (164)..(164): n is a, c, g, or t
aacatggcttcctgatagnccagctccacctcttctctggagaccaccatctgtactgtattccatctttcaggattatccacccattggtggccattgacagcaacctgggttcctaacggtttggttaacaccagcacgtccccaacgacggcgctgtccgncattatgaactcatttggttggcatactacagtggcaactccaccgattataatccaagggttgaccaccgtttgcccaccggtcactgccgtccctccttctctctccactcccgggagtggagagagaatgactgatggaatattttttctctctgtagaacttcctgcagggactgctcaccaaagacccacggcagcgactgtcctggccagacctcttatatcacccctttattgctggtcatgtcaccagtgagtcatcagggttcccagggctcttggacttcccagtacttcctctaaactacttccctttcacttccccgaccatctagatataacatgtcgtctttcctccagcagcttgaactttcttcctagcccttcacttaacctttgccacttcccttacaacccactctctctctgtcactttttcaaaatgatcttctgcccacagaagcctgg

SEQ ID NO: 422624 - DNA, 4912 bp, Homo sapiens
agcgtcgtttctaggcaaccgcagactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaga

SEQ ID NO: 422625 - DNA, 4799 bp, Homo sapiens
aacgccagggaatccgtcccttggcctgaggagcttggagctcctaggctgggggcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaga

SEQ ID NO: 422626 - DNA, 4863 bp, Homo sapiens
agcgtcgtttctaggcaaccgcagactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaga

SEQ ID NO: 422627 - DNA, 4276 bp, Homo sapiens
cactgggactgaaggtttgggagaggagctgttacagtgcgaagtaccccagcggctcctagaaatggcatgtggagacccccagccaaatgtgaaggaggcggccctcattgccctccggagcctgcaacaggagcctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaga

SEQ ID NO: 422628 - DNA, 4246 bp, Homo sapiens
tattcacaagaattagttaatttttaacaagaacttactgttagcgtcctggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaga

SEQ ID NO: 422629 - DNA, 1690 bp, Homo sapiens
agcgtcgtttctaggcaaccgcagactccgggtccttagccgggcctgatggccctgaggcagttcggatgtgtcccaggaagtgcccatgtgtggtccgccgtccattccacacctctgagcgcctttgtcctctgaacttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaga

SEQ ID NO: 422630 - DNA, 273 bp, Homo sapiens
gcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtacttgggcagctagcatgaaggtgggagaggaagatagccaaccttgtatcctctaatttacttcccagcagctccagggctcttctaggcccctgtaagcatggaacagctggcttgactca

SEQ ID NO: 422631 - DNA, 445 bp, Homo sapiens
gttttttctattctttgtttccatccttcacattgcccttactctcttctccttttcctgggcagcaatcttggtatgggaccttcttacaggacctgatggctgtgattcaggcctactttgcctgtaccttcaatctggagaggagccagacaagtgacaggtaggataagaagtgcttttgcattgttggcaagtttggcttctgtttctaccccaagtgcccttcccatttaggaacaggccaagtatgaagaagctgtgatttgttacaggtttaggaatcagctgagtggccactcatagtccttttaaggaccctaagacagctccaacttggcctcaagacttacagtttctaagagtcagcagtcaccatggtcctaaaatggaagggtcaagatgtgaataacctattccaggaagccaattggattaaagaaag

SEQ ID NO: 422632 - DNA, 6980 bp, Homo sapiens
cttgaacttattgagaaactcctccagaacagaattacaattgtggatagatttcttaattcttcaaatgatcataggtttcaggctcttcaagacaattgtaaaaaaattttaggagaaaatgctaaacccaattatggttgtcaagtcactattcagtctgaacaagaaaagcagttaatgaaacaatatcgacgtgaagaaaaaagaattgccagacgagaaaaaaaggctggagaagatttagaagtttcagaaggacttatgtgctttgatcctaaggaattgcggatacaaagagaacaggcacttctgaatgctagaagtgttccaattctgagcaggcagagagatgcagacgttgaaaaaatacattatccccatgtgtatgattcccaggctgaagccatgaaaacatcagcatttattgctggtgcaaagatgattttgccagaaggaatccaaagagagaataacaagctttatgaagaagtaaggattccctacagcgaaccaatgccactcagctttgaggaaaagccagtttatatccaagacttagatgagatcggacagctggcttttaaaggaatgaagagactcaatagaatccagtcaatagtgtttgagactgcctacaacaccaatgagaacatgctgatttgtgcccctacaggagctggaaaaaccaacattgcaatgctgacagtcttgcatgaaattcgccaacattttcaacaaggtgttatcaaaaagaatgaatttaagattgtatatgttgctccaatgaaagccttggcagctgaaatgacagattacttcagcagacgtctagagccactaggcatcattgtgaaagaattgactggtgacatgcagttgtccaaaagtgaaattttacgaactcagatgcttgtgaccacaccagaaaaatgggatgtagtgacaagaaagagtgttggggatgtagctctttcccagattgtaaggctccttattcttgatgaagttcatttgctgcatgaagatagaggaccagtattagaaagcatagttgcccgtactttacggcaggtggaatccacacagagtatgataaggattctcggactgtctgcaactttacctaactacctcgatgttgccacatttttacatgttaatccatacattggacttttcttctttgatggccgttttcgaccagtacctcttggacagacatttttggggattaaatgtgcaaataagatgcagcagttgaataacatggatgaagtatgttatgaaaatgttttgaagcaagtaaaggctggacaccaggtgatggtgtttgtacatgctcgaaatgccactgtaagaacagctatgtctctaatagaaagagcaaaaaattgtggccatattcccttcttttttcctacccaaggacatgactatgtacttgcagaaaaacaggtacaaaggtcgagaaataagcaagtacgagaattattcccagatggttttagtattcatcatgcaggaatgcttcggcaggacagaaatttagttgaaaacttgttttctaatgggcatatcaaagtcctagtgtgtacagctacgttagcctggggtgtcaatcttcccgcccatgctgttattattaagggaacacaaatatatgctgcaaaaagaggctcctttgttgaccttggaattttagatgtcatgcagatatttggtcgagctggacgaccacaatttgacaaatttggggaaggaataattataacaacgcatgataaactcagccattacctcactttgctcactcaacgaaacccaattgagagtcagtttctggaaagccttgcagataacctaaatgcagagattgctctgggaacagttactaatgtggaagaagcagtgaagtggataagttacacttatctttatgtacggatgagagcaaatccattagcatatggcatcagtcacaaggcttatcagattgacccaacattaagaaagcatcgagaacagttggtcattgaagttggacgaaaactagacaaagctcagatgattcgttttgaggagcgaactggatatttttcctcaactgatttgggtagaactgccagccattactatattaaatacaacaccattgagacctttaatgaactctttgatgctcacaaaacagaaggtgatatctttgccatagtctccaaagctgaagaatttgatcaaattaaggtcagagaagaggaaatagaggagttagataccttattaagcaatttttgtgaactctccactcctggaggtgtagagaatagttatgggaaaataaacatcttacttcaaacttatatcagccgaggagaaatggacagtttctcccttatatcagattctgcatatgttgcacagaatgcagctagaattgtccgtgctctttttgaaattgctctgaggaaacgttggcctaccatgacctacaggctcctgaatcttagtaaagtcattgacaagaggctttggggttgggctagccctttgagacaattttcaatcctaccaccacacatcctaacaagattagaagaaaaaaagcttactgtggataagctgaaagacatgaggaaagatgaaataggtcacattttacatcatgtgaatattggactgaaggtcaaacaatgtgttcatcagattccttctgttatgatggaagcatccattcagcccatcacaaggactgtcctccgagtgacactcagcatctatgctgatttcacttggaatgatcaggtacatgggacagtaggagaaccttggtggatttgggtagaagatcctacaaatgatcatatttatcattcagagtattttctagctctaaaaaaacaagtcattagtaaagaagcccaactactggtatttacaatccctatttttgagcctttgccttcccaatactacatccgagcagtgtctgatagatggttgggtgctgaggcagtatgtattatcaactttcaacatctaattctaccagagagacatcctcctcatacagaattactggatcttcagcctttaccaatcacagctttgggatgtaaagcatatgaagccctgtacaacttcagccactttaaccctgtacagacacaaatatttcatacattgtatcacacggattgtaatgtcctacttggagcacctactggatcgggaaagactgttgcagctgaattagccattttcagagtcttcaacaaataccctacttcaaaggcggtatatattgcacccctaaaagccctagtacgtgaaagaatggatgattggaaagttagaatagaagaaaaacttggtaaaaaagttattgaactaacaggggatgtgactcctgatatgaaatccattgccaaggctgaccttatcgtcactacgccagagaagtgggatggagtcagcagaagctggcaaaataggaactatgttcagcaagtcactattctcatcatagatgagatccatctgcttggggaggaaagaggccctgttctagaggtcattgtatctcgaacaaattttatctcatcacacacagaaaagcctgttagaatagttggactatctactgcattagctaatgccagagaccttgctgattggctcaatattaagcagatgggcttgtttaacttccgaccatcagtacgcccagttccactggaagttcacattcaaggctttccaggtcaacattactgtcctcgtatggctagtatgaacaagcctgcatttcaggcaattagaagccattctccagccaaacctgttttgatatttgtctcatcaagacgtcaaactcgtcttactgctttggaattgatcgccttcctggctactgaagaagatccaaagcagtggttaaacatggatgaaagagagatggagaacatcattgcaacagtaagagattccaacctcaagctgacccttgctttcgggataggaatgcatcatgctggactacatgagagggaccgaaaaacagtagaggaactatttgtaaactgtaaagttcaggttcttattgctacaagcacattagcctggggtgtaaactttccagctcatttagtaattattaagggaacagaatactatgatggaaaaacaagacgttatgtggattttcccattacagatgtcctccagatgatggggcgtgctgggaggccgcagttcgatgaccaaggcaaagctgtaattctagttcatgacataaagaaagacttttataaaaaatttctttatgaacctttcccagtagaatcaagtttattaggagtgctctctgaccacttaaatgcagagattgctggtggtacaattacatctaagcaagatgcattggattatatcacctggacttactttttccgacgtcttatcatgaatcccagctattacaatttgggtgatgtgagccatgattctgtgaacaagtttctgtcccatctgattgagaagtccctgattgaattggaactttcctactgtattgaaattggagaggataatcgcagcattgaacctctaacttatggccgaattgcctcctattactatttgaagcatcaaacagttaaaatgttcaaggaccgcttgaagcctgaatgcagtactgaagaactgctttcaattctaagtgatgcagaagaatatacagatttgccagtgagacacaatgaagatcatatgaatagtgaactggcaaaatgtcttcccattgaatcaaatcctcattcatttgacagccctcacaccaaagcacatctcctgctacaggcacatctcagccgagccatgctaccctgcccagattatgacactgataccaaaacagtcttggaccaagctctcagagtatgtcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagaaatggaagccgattatgaagggcccacatgctaggggtcggacctccatcgagtgccttcctgaactgatccatgcctgtggagggaaagaccatgtatttagctccatggtagaaagtgagctacatgctgcaaaaacgaaacaggcatggaatttcttatctcacttgccagtgataaatgttggcataagtgttaaaggctcgtgggatgacttagttgaaggacataatgaactctctgtctcaactctgactgcagacaaacgagatgacaacaaatggatcaaattgcatgctgaccaagagtatgtgcttcaagtgagcttgcagagagtccactttgggttccacaagggaaagccagagagctgtgcagttactcctcgatttcccaaatcaaaagacgaaggatggtttttgatattaggagaagtggataagagagaacttattgctttgaaaagagtaggatatattcgaaatcatcatgttgcttccctttctttttatacccctgaaatacctggaaggtatatctacacattatatttcatgagtgactgctaccttggcctggaccagcagtatgacatctatctcaacgttacacaagcgagtctttctgcacaggtcaacaccaaggtctctgattccctgactgacctggcattaaagtaacttgacctgaacaatccatttgaaaggagtggctaagaattctctctgttcagtcatctagacaaatcgaattacttgatgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataaatctgtaaggtggtacacagcgtgtcttgttagcaaaatttatactttgatatgatcacatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaagacaagctgactcaatgttttcttctgcttcctttaaataatatccccttactcatctgttcttcttttctttcccttctacttcaaggctttatttctattatctttctgacatatttatttacagaagtagagaagtataatctaattcatgttgtagcacttacagatcatatagtacaattatttgtctttatgctctccaggaaaaatctgagacagaaaatttttcacccctatggataggttttcacctgtaataaagaaaatttctctatgtccaaacaaattccttcttgaaaaatactttttcaaactaaaaacttgttaaaattcaatgttcatataatatgcattctagtggaatgaaattctacctttgtgaaataatttcagttttcttagccctaaaatgaattattttaaaacattttccaatgtcattgttacaaatactagaatttaagtgtttctgaaattggaatgtattgcttgtatatatccttttccatgcttaaataaaaaagaagaagaaataaatgtaggt

SEQ ID NO: 422633 - DNA, 6456 bp, Homo sapiens
cttgaacttattgagaaactcctccagaacagaattacaattgtggatagatttcttaattcttcaaatgatcataggtttcaggctcttcaagacaattgtaaaaaaattttaggagaaaatgctaaacccaattatggttgtcaagtcactattcagtctgaacaagaaaagcagttaatgaaacaatatcgacgtgaagaaaaaagaattgccagacgagaaaaaaaggctggagaagatttagaagtttcagaaggacttatgtgctttgatcctaaggaattgcggatacaaagagaacaggcacttctgaatgctagaagtgttccaattctgagcaggcagagagatgcagacgttgaaaaaatacattatccccatgtgtatgattcccaggctgaagccatgaaaacatcagcatttattgctggtgcaaagatgattttgccagaaggaatccaaagagagaataacaagctttatgaagaagtaaggattccctacagcgaaccaatgccactcagctttgaggaaaagccagtttatatccaagacttagatgagatcggacagctggcttttaaaggaatgaagagactcaatagaatccagtcaatagtgtttgagactgcctacaacaccaatgagaacatgctgatttgtgcccctacaggagctggaaaaaccaacattgcaatgctgacagtcttgcatgaaattcgccaacattttcaacaaggtgttatcaaaaagaatgaatttaagattgtatatgttgctccaatgaaagccttggcagctgaaatgacagattacttcagcagacgtctagagccactaggcatcattgtgaaagaattgactggtgacatgcagttgtccaaaagtgaaattttacgaactcagatgcttgtgaccacaccagaaaaatgggatgtagtgacaagaaagagtgttggggatgtagctctttcccagattgtaaggctccttattcttgatgaagttcatttgctgcatgaagatagaggaccagtattagaaagcatagttgcccgtactttacggcaggtggaatccacacagagtatgataaggattctcggactgtctgcaactttacctaactacctcgatgttgccacatttttacatgttaatccatacattggacttttcttctttgatggccgttttcgaccagtacctcttggacagacatttttggggattaaatgtgcaaataagatgcagcagttgaataacatggatgaagtatgttatgaaaatgttttgaagcaagtaaaggctggacaccaggtgatggtgtttgtacatgctcgaaatgccactgtaagaacagctatgtctctaatagaaagagcaaaaaattgtggccatattcccttcttttttcctacccaaggacatgactatgtacttgcagaaaaacaggtacaaaggtcgagaaataagcaagtacgagaattattcccagatggttttagtattcatcatgcaggaatgcttcggcaggacagaaatttagttgaaaacttgttttctaatgggcatatcaaagtcctagtgtgtacagctacgttagcctggggtgtcaatcttcccgcccatgctgttattattaagggaacacaaatatatgctgcaaaaagaggctcctttgttgaccttggaattttagatgtcatgcagatatttggtcgagctggacgaccacaatttgacaaatttggggaaggaataattataacaacgcatgataaactcagccattacctcactttgctcactcaacgaaacccaattgagagtcagtttctggaaagccttgcagataacctaaatgcagagattgctctgggaacagttactaatgtggaagaagcagtgaagtggataagttacacttatctttatgtacggatgagagcaaatccattagcatatggcatcagtcacaaggcttatcagattgacccaacattaagaaagcatcgagaacagttggtcattgaagttggacgaaaactagacaaagctcagatgattcgttttgaggagcgaactggatatttttcctcaactgatttgggtagaactgccagccattactatattaaatacaacaccattgagacctttaatgaactctttgatgctcacaaaacagaaggtgatatctttgccatagtctccaaagctgaagaatttgatcaaattaaggtcagagaagaggaaatagaggagttagataccttattaagcaatttttgtgaactctccactcctggaggtgtagagaatagttatgggaaaataaacatcttacttcaaacttatatcagccgaggagaaatggacagtttctcccttatatcagattctgcatatgttgcacagaatgcagctagaattgtccgtgctctttttgaaattgctctgaggaaacgttggcctaccatgacctacaggctcctgaatcttagtaaagtcattgacaagaggctttggggttgggctagccctttgagacaattttcaatcctaccaccacacatcctaacaagattagaagaaaaaaagcttactgtggataagctgaaagacatgaggaaagatgaaataggtcacattttacatcatgtgaatattggactgaaggtcaaacaatgtgttcatcagattccttctgttatgatggaagcatccattcagcccatcacaaggactgtcctccgagtgacactcagcatctatgctgatttcacttggaatgatcaggtacatgggacagtaggagaaccttggtggatttgggtagaagatcctacaaatgatcatatttatcattcagagtattttctagctctaaaaaaacaagtcattagtaaagaagcccaactactggtatttacaatccctatttttgagcctttgccttcccaatactacatccgagcagtgtctgatagatggttgggtgctgaggcagtatgtattatcaactttcaacatctaattctaccagagagacatcctcctcatacagaattactggatcttcagcctttaccaatcacagctttgggatgtaaagcatatgaagccctgtacaacttcagccactttaaccctgtacagacacaaatatttcatacattgtatcacacggattgtaatgtcctacttggagcacctactggatcgggaaagactgttgcagctgaattagccattttcagagtcttcaacaaataccctacttcaaaggcggtatatattgcacccctaaaagccctagtacgtgaaagaatggatgattggaaagttagaatagaagaaaaacttggtaaaaaagttattgaactaacaggggatgtgactcctgatatgaaatccattgccaaggctgaccttatcgtcactacgccagagaagtgggatggagtcagcagaagctggcaaaataggaactatgttcagcaagtcactattctcatcatagatgagatccatctgcttggggaggaaagaggccctgttctagaggtcattgtatctcgaacaaattttatctcatcacacacagaaaagcctgttagaatagttggactatctactgcattagctaatgccagagaccttgctgattggctcaatattaagcagatgggcttgtttaacttccgaccatcagtacgcccagttccactggaagttcacattcaaggctttccaggtcaacattactgtcctcgtatggctagtatgaacaagcctgcatttcaggcaattagaagccattctccagccaaacctgttttgatatttgtctcatcaagacgtcaaactcgtcttactgctttggaattgatcgccttcctggctactgaagaagatccaaagcagtggttaaacatggatgaaagagagatggagaacatcattgcaacagtaagagattccaacctcaagctgacccttgctttcgggataggaatgcatcatgctggactacatgagagggaccgaaaaacagtagaggaactatttgtaaactgtaaagttcaggttcttattgctacaagcacattagcctggggtgtaaactttccagctcatttagtaattattaagggaacagaatactatgatggaaaaacaagacgttatgtggattttcccattacagatgtcctccagatgatggggcgtgctgggaggccgcagttcgatgaccaaggcaaagctgtaattctagttcatgacataaagaaagacttttataaaaaatttctttatgaacctttcccagtagaatcaagtttattaggagtgctctctgaccacttaaatgcagagattgctggtggtacaattacatctaagcaagatgcattggattatatcacctggacttactttttccgacgtcttatcatgaatcccagctattacaatttgggtgatgtgagccatgattctgtgaacaagtttctgtcccatctgattgagaagtccctgattgaattggaactttcctactgtattgaaattggagaggataatcgcagcattgaacctctaacttatggccgaattgcctcctattactatttgaagcatcaaacagttaaaatgttcaaggaccgcttgaagcctgaatgcagtactgaagaactgctttcaattctaagtgatgcagaagaatatacagatttgccagtgagacacaatgaagatcatatgaatagtgaactggcaaaatgtcttcccattgaatcaaatcctcattcatttgacagccctcacaccaaagcacatctcctgctacaggcacatctcagccgagccatgctaccctgcccagattatgacactgataccaaaacagtcttggaccaagctctcagagtatgtcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagaaatggaagccgattatgaagggcccacatgctaggggtcggacctccatcgagtgccttcctgaactgatccatgcctgtggagggaaagaccatgtatttagctccatggtagaaagtgagctacatgctgcaaaaacgaaacaggcatggaatttcttatctcacttgccagtgataaatgttggcataagtgttaaaggctcgtgggatgacttagttgaaggacataatgaactctctgtctcaactctgactgcagacaaacgagatgacaacaaatggatcaaattgcatgctgaccaagagtatgtgcttcaagtgagcttgcagagagtccactttgggttccacaagggaaagccagagagctgtgcagttactcctcgatttcccaaatcaaaagacgaaggatggtttttgatattaggagaagtggataagagagaacttattgctttgaaaagagtaggatatattcgaaatcatcatgttgcttccctttctttttatacccctgaaatacctggaaggtatatctacacattatatttcatgagtgactgctaccttggcctggaccagcagtatgacatctatctcaacgttacacaagcgagtctttctgcacaggtcaacaccaaggtctctgattccctgactgacctggcattaaagtaacttgacctgaacaatccatttgaaaggagtggctaagaattctctctgttcagtcatctagacaaatcgaattacttgatgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataaatctgtaaggtggtacacagcgtgtcttgttagcaaaatttatactttgatatgatcacatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaagacaagctgactcaatgttttct

SEQ ID NO: 422634 - DNA, 2552 bp, Homo sapiens
  misc_feature (2071)..(2071): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422635 - DNA, 2027 bp, Homo sapiens
  misc_feature (1998)..(1998): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaanaaaaactaaaaatgaaattgaaaaactag

SEQ ID NO: 422636 - DNA, 2483 bp, Homo sapiens
  misc_feature (18)..(18): n is a, c, g, or t
  misc_feature (2002)..(2002): n is a, c, g, or t
agcaggcttgtacgcccnggagttatggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422637 - DNA, 2186 bp, Homo sapiens
  misc_feature (1705)..(1705): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422638 - DNA, 2522 bp, Homo sapiens
  misc_feature (2041)..(2041): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaaaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422639 - DNA, 2313 bp, Homo sapiens
  misc_feature (1832)..(1832): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422640 - DNA, 2661 bp, Homo sapiens
  misc_feature (2180)..(2180): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgctgtacaagaaagcagggtggcagcaatctgctatctgtggacggaccatccggaaagccttcaattcatggctggcaagggcaaggggagccaggctcggcaccagtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422641 - DNA, 2381 bp, Homo sapiens
  misc_feature (1900)..(1900): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggtcagtgggagacaggctggagtgcaatggcacaatctcggctcaccgcaacctccgcctcccgggttcaagcgattctcctgcctcagcctcctgagtagctgggattacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgctgtacaagaagcagggtgccagcatctgcttctgttgaggacctccggaagcttccattcatggtggaaggccaaggggagcaggcttgtcacatgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422642 - DNA, 1811 bp, Homo sapiens
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtcgggctatcggggagggatcctctagatca

SEQ ID NO: 422643 - DNA, 1325 bp, Homo sapiens
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcagccggtgacagacacctgggcaagatcctctagagtaccc

SEQ ID NO: 422644 - DNA, 1178 bp, Homo sapiens
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatgagagaggggcgccacagagctctatcagactgcagatgatcactcagttcgcactctctga

SEQ ID NO: 422645 - DNA, 1602 bp, Homo sapiens
  misc_feature (1121)..(1121): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagtttgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422646 - DNA, 1686 bp, Homo sapiens
  misc_feature (1205)..(1205): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgcacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422647 - DNA, 1572 bp, Homo sapiens
  misc_feature (1091)..(1091): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422648 - DNA, 1420 bp, Homo sapiens
  misc_feature (939)..(939): n is a, c, g, or t
gtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccacatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggaaaaaaaaaaaaaaaaaaaaaaaaaaaaaaaccccggagcgccacaccagggcgagcgggcgcggagaaaaagaganaggcaaaggacaagagggccacaggggcacaacacacgcggcaccgcggccacccacaccccgtggccaaaaaggggcgacaacacgcggcgcgggccactaccacacacacacagagaggagacccaaaatacacatcatcgccaaagacaggacgcccgagagcgatcaaccaccgagcgcacaccagggaacccagacgaacacaaacaacacaaaccacgacgtggagacagattgacatccacacgcccgcgtccctccactcctccgagttcgcggggacggtgggacacctctcaccactcggatgcagggaatcaacgacagatcagagaagtgacggaccatcaatacgaggacgcaagagcgaacatccatccgattcgttggtagaggtgaatgggcgcaatgaataaaacacttcgcgggcgagctcgttcgaggtgacaggagcaccacacaaaacacaagacgcccc

SEQ ID NO: 422649 - DNA, 421 bp, Homo sapiens
tggaatctatcccaatctaaaggagcttctgccaaaggacaggagattacttatgctgcctgaaatggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422650 - DNA, 2182 bp, Homo sapiens
ggagagggggcgggcactctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422651 - DNA, 2323 bp, Homo sapiens
ggagagggggcgggcactctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcgaaaaaaaaaaaaaaaaaagggggggggctaaaaaatcccggggccagttaggtaccggtttttgacagggcccaagggggattaagaaacaggggggtaaaagggagggaaaggctggttcggaggccccttggggaaggac

SEQ ID NO: 422652 - DNA, 372 bp, Homo sapiens
  misc_feature (14)..(15): n is a, c, g, or t
tacctgtgcatgannatcactgcaatctatgtcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagattgcagtgatggtcatgctagcacgccgcc

SEQ ID NO: 422653 - DNA, 1324 bp, Homo sapiens
gctcggtacccagttcgacggagactctcatccacccgggagttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgtccatctcttcacagtcatggctgatcttgtcatccacttttgggagattctactgtatctgggcagggtatgccttctctacatcaggatctcactcccatcacccagaatgcagtgctgtggcacgatcacagctctctgcagcctcaatttcccaggctcaagcaattctcccacctcagcctcccgagaagctggaactacaggaatgtgccaccgcatcgggctaatgttttgtatttttggtagagacagggtttagccatgttgcccaggctggtctcgaattcttgggctcaagcaatcctctcacctcagcctcctaaagtgcttggactagaggtgcaaatcaccatgcctgaccctttatctctacttttggccagaagcaatccagttaacactctatcatatattattcctcctactgttttctcctctctaaattcttcagctttggctgtttgcccattagtcactgcctgggagttttcaacttttaaaatttgtgacaacattgttaggtcattaagatgggtcctcatccgatgtaactggcgttcttacaagaagcagggaaatgacgtggcggagacacaggagggggaaataccgcgtgatgatggagttaaagacaggagttatgcagctgcaagccaagaacaccaagggctgctggtgacagcaagcgaggagggagcctggccctgctggcatcttgattcagacttccagcccctaccactctgagagaataaattcctgttgttttaagccacccagtttagggtgctttgttgcagccgccttaagaaaggaatacatcgtatcattcccagaaactgcttgagtcccagggtttgagactggaaagtgctgagcctccctcactaccagatgccaccttggcgagggtgagtaggtaggaaaggctgagcagtgaccccacattcatgtgctatggcacatttgagaacataccaaacaggaaatgaaactgatgtgaaacagaaatttccgtcataaaaacaatttgcatgaaacgttcactgtactaaaaaagtagatgatttaggacaattttaacttttaccctgaaaataaatgtttaaaccattcatgatgaaaa

SEQ ID NO: 422654 - DNA, 2136 bp, Homo sapiens
ggagagggggcgggcactctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggagaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422655 - DNA, 2150 bp, Homo sapiens
ggagagggggcgggcactctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422656 - DNA, 2228 bp, Homo sapiens
ggagagggggcgggcactctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcgaaaaaaaaagtcgaccggccgcgaatttagtagtagtagtaggcggc

SEQ ID NO: 422657 - DNA, 2231 bp, Homo sapiens
ggagagggggcgggcactctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcgaaaaaacaaaacaacacaaaacaaaacaacacaaacacaaaaaaaagggg

SEQ ID NO: 422658 - DNA, 1379 bp, Homo sapiens
cttggccccgccccctgttgacatccggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422659 - DNA, 1282 bp, Homo sapiens
gctcggtacccagttcgacggagactctcatccacccgggagttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422660 - DNA, 1719 bp, Homo sapiens
ttttttaaggctattatctcctttattcaaaaaataaatatttcactttgattcaacatatttcaaatcacattaagcacagagaagaaatacagtccctttggagattgtgaacacgtgttggaaagaagcatgatccaaacaatgggaatgaggtgagtgtggattccagctgtttcctgacccagaggttccatccctcttcaggtggagctacttatcgatttttaggagagaaaaagaagcacacacacacacacacacacacacacacgtgcacacacacacgcgcacacacacacgcgtgtacatatacatacacatctgacatgaataaatgtaagaaggaacacagcatattaagaggaactgaaggaagtccagtgtgattggaatgcagagggcaagggggtgatagttggaagagaccagatattgtaagaaatcaagactttggtgattaggagctggttttactcatcattctgtctaggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422661 - DNA, 1649 bp, Homo sapiens
actatgtataggcattggtgggtattggagatgtggtgatgaacatttaacaaatctaatgaacatgtgtgcacatatatgtgtctctctctttatatatacatatatttttcatattcaatgtagcttctaatattctattggaatactatagtcaattatacacacatatacacatatactccccctacccctcacacacacgtgcacacacacacgcgcacacacacacgcgtgtacatatacatacacatctgacatgaataaatgtaagaaggaacacagcatattaagaggaactgaaggaagtccagtgtgattggaatgcagagggcaagggggtgatagttggaagagaccagatattgtaagaaatcaagactttggtgattaggagctggttttactcatcattctgtctaggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422662 - DNA, 1194 bp, Homo sapiens
ggaatctatcaccgggagttgaggaggttgtggtgatagattgtgtgatgatgatcacaactgaggagacgaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422663 - DNA, 1002 bp, Homo sapiens
  misc_feature (14)..(15): n is a, c, g, or t
tacctgtgcatgannatcactgcaatctatgtcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422664 - DNA, 1663 bp, Homo sapiens
ttttttaaggctattatctcctttattcaaaaaataaatatttcactttgattcaacatatttcaaatcacattaagcacagagaagaaatacagtccctttggagattgtgaacacgtgttggaaagaagcatgatccaaacaatgggaatgaggtgagtgtggattccagctgtttcctgacccagaggttccatccctcttcaggtggagctacttatcgatttttaggagagaaaaagaagcacacacacacacacacacacacacacacgtgcacacacacacgcgcacacacacacgcgtgtacatatacatacacatctgacatgaataaatgtaagaaggaacacagcatattaagaggaactgaaggaagtccagtgtgattggaatgcagagggcaagggggtgatagttggaagagaccagatattgtaagaaatcaagactttggtgattaggagctggttttactcatcattctgtctaggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaattctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422665 - DNA, 1205 bp, Homo sapiens
tcttcttgatcatcctttatttttcatctactcatgcttagctcttctatactctataattacacattttccatttcacattattcgtacactctctattaatctagtgcgcacttcctacaaacaaaactggaggtcgcttccctactagattatgactatcttgctcacaactatgttgctgtagacacggcatcccataacatcaaagaacaatgactacagatacacgcgagtatccacatatatttaagatcagctctattgaatacaagcagtgttctaaacaggtctagctgatcgagatacgtctaataggggggacatacaacagatcttggggtgtaatccggcgttcaaggcctccatcagtcaatcggtgctcgtatatctcctagattctatatatttgcaatctatactcccatccttaaaggagctcatgtccaaagaacaggagatgactttagtgcatgccatcaaactggcctagtgaactctctaaagtttccgctttccaatagcaagggtccattcacaatggattactacactgtagaccaactcctgtctgattactgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422666 - DNA, 2224 bp, Homo sapiens
ggagagggggcgggcactctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgtccatctcttcacagtcatggctgatcttgtcatccacttttgggagattctactgtatctgggcagggtatgccttctctacatcaggatctcactcccatcacccagaatgcagtgctgtggcacgatcacagctctctgcagcctcaatttcccaggctcaagcaattctcccacctcagcctcccgagaagctggaactacaggaatgtgccaccgcatcgggctaatgttttgtatttttggtagagacagggtttagccatgttgcccaggctggtctcgaattcttgggctcaagcaatcctctcacctcagcctcctaaagtgcttggactagaggtgcaaatcaccatgcctgaccctttatctctacttttggccagaagcaatccagttaacactctatcatatattattcctcctactgttttctcctctctaaattcttcagctttggctgtttgcccattagtcactgcctgggagttttcaacttttaaaatttgtgacaacattgttaggtcattaagatgggtcctcatccgatgtaactggcgttcttacaagaagcagggaaatgacgtggcggagacacaggagggggaaataccgcgtgatgatggagttaaagacaggagttatgcagctgcaagccaagaacaccaagggctgctggtgacagcaagcgaggagggagcctggccctgctggcatcttgattcagacttccagcccctaccactctgagagaataaattcctgttgttttaagccacccagtttagggtgctttgttgcagccgccttaagaaaggaatacatcgtatcattcccagaaactgcttgagtcccagggtttgagactggaaagtgctgagcctccctcactaccagatgccaccttggcgagggtgagtaggtaggaaaggctgagcagtgaccccacattcatgtgctatggcacatttgagaacataccaaacaggaaatgaaactgatgtgaaacagaaatttccgtcataaaaacaatttgcatgaaacgttcactgtactaaaaaagtagatgatttaggacaattttaacttttaccctgaaaataaatgtttaaaccattcatgatgaaaa

SEQ ID NO: 422667 - DNA, 1164 bp, Homo sapiens
ggagagggggcgggcactctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 422668 - DNA, 251 bp, Homo sapiens
cggcacgagggaataaacgaaaaaggaagtagcttaaactgggaagcttaagacacagaaatttatttctcatgaatttggaaagtgggaaatccaagagcaaggtgccagccaaattgattcctggtgagaggcttcttcacggtttagcccagccatcttcctgccatgtcccaatatggtagaaagaagtggatggatgttgttccttttttgaagttgtcattaaagtaggtgcaacaaccaaaaaa

SEQ ID NO: 422669 - DNA, 2433 bp, Homo sapiens
cgcggcggtccgcggggcggggccgggggcgcgtccgggtggtggcggtggctgcggcgacggcggtcgcgtcggcgtcaggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgaggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagcgagaaggtttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaaaaaa

SEQ ID NO: 422670 - DNA, 2452 bp, Homo sapiens
cgcggcggtccgcggggcggggccgggggcgcgtccgggtggtggcggtggctgcggcgacggcggtcgcgtcggcgtcaggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgaggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagcgagaaggtttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctcccccttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaaaaaa

SEQ ID NO: 422671 - DNA, 2313 bp, Homo sapiens
cgcggcggtccgcggggcggggccgggggcgcgtccgggtggtggcggtggctgcggcgacggcggtcgcgtcggcgtcaggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccaggtggtgcggatagcgctcaacgcagtagacaccatttcctacggagaattccagtttccccctaaatcgctcaacaagcgagaaggtttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaaaaaa

SEQ ID NO: 422672 - DNA, 2275 bp, Homo sapiens
cgcggcggtccgcggggcggggccgggggcgcgtccgggtggtggcggtggctgcggcgacggcggtcgcgtcggcgtcaggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgagcgagaaggtttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctcccccttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaaaaaa

SEQ ID NO: 422673 - DNA, 1417 bp, Homo sapiens
tataccccctccgtctctgtaatccgcctttaggatatcgtacagaacctgttagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaaaaaa

SEQ ID NO: 422674 - DNA, 2147 bp, Homo sapiens
cgcggcggtccgcggggcggggccgggggcgcgtccgggtggtggcggtggctgcggcgacggcggtcgcgtcggcgtcaggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgaggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagcgagaaggtttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatcctcagaagctggctggggactctagcctctgtgttcataaagacattaagaagtggatggatgttgttccttttttgaagttgtcattaaagtaggtgcaacaaccaaaaaa

SEQ ID NO: 422675 - DNA, 2164 bp, Homo sapiens
cgcggcggtccgcggggcggggccgggggcgcgtccgggtggtggcggtggctgcggcgacggcggtcgcgtcggcgtcaggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccgggcgagaaggtttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaaaaaa

SEQ ID NO: 422676 - DNA, 2698 bp, Homo sapiens
  misc_feature (2465)..(2465): n is a, c, g, or t
cgcggcggtccgcggggcggggccgggggcgcgtccgggtggtggcggtggctgcggcgacggcggtcgcgtcggcgtcaggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgaggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagcgagaaggtttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaaaaaaaaataatattatttatttatatattaaaattntatttttatatttatattcttctctttccctcttacctacttttctccatatccttcctcctctttttatacaaaaaaaaaaacaactggggggggggcccggtcccaatattgccctttggggggcgttttcaaataaaaggggcggcgtttaacacgtcggtcttgggaaacacctgcgttccccacttaacgcgttggagaaatccccttttgcacgttgtgtatatagg

SEQ ID NO: 422677 - DNA, 353 bp, Homo sapiens
gaatgcttggcagaaagcacgcacctgaccttagcaggtgcacaatgagcatttgaatgagagttggatggagtggatggatgtaagcaaaatactcaaattcattggcacctttgtgttagttttaaaaaatgttcacggaaaaattgagggatctcttacttttcattttcttcttattagctaaccacagaattaatgacatgcattctcattgggtatgctcacgactgtaatcccagcactttgggaggccgaggcaggtgtatcacttgagcccaggtgttcaaggaagaccagcctgggcaacagagaccctgtctctacaaaaaatacaaaaattagccaagcat

SEQ ID NO: 422678 - DNA, 419 bp, Homo sapiens
agaaaaatgagagagaatttttggttaccccagttgaaaaagtagtagctttaataggaaggtatatgatgcggtgaaggaagggtagtacctacgataatgcagtatgccctgaattaccccacaagattttcccttatttatataaagtgaagattacttaactcagtttaggatactattaaatttgctttgaaatatttgcattaaaattttcaatagtttttcatgagcaggtcaataagatatttataaattatagtttgcagaatttaatttgtatgaatcaaatgcccagagcttaagattgattattccctcttcagtgttgcctagagcagtgggtaatagcattaacaataaaagcaaagaagtctgattagatacgatggtttttaaagaaatcaatttaaaaaaaa

SEQ ID NO: 422679 - DNA, 3658 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttcttttcttttctttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaaaaaagcttttttg

SEQ ID NO: 422680 - DNA, 1798 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgtgagtgggccagaaggcgaacatggcggagcggggaggctggcgggag

SEQ ID NO: 422681 - DNA, 2328 bp, Homo sapiens
  misc_feature (1823)..(1823): n is a, c, g, or t
  misc_feature (1866)..(1866): n is a, c, g, or t
  misc_feature (1898)..(1898): n is a, c, g, or t
  misc_feature (1915)..(1915): n is a, c, g, or t
  misc_feature (1917)..(1917): n is a, c, g, or t
  misc_feature (1938)..(1938): n is a, c, g, or t
  misc_feature (2016)..(2016): n is a, c, g, or t
  misc_feature (2057)..(2057): n is a, c, g, or t
  misc_feature (2075)..(2075): n is a, c, g, or t
  misc_feature (2091)..(2091): n is a, c, g, or t
  misc_feature (2097)..(2097): n is a, c, g, or t
  misc_feature (2099)..(2099): n is a, c, g, or t
  misc_feature (2101)..(2101): n is a, c, g, or t
  misc_feature (2124)..(2124): n is a, c, g, or t
  misc_feature (2126)..(2126): n is a, c, g, or t
  misc_feature (2160)..(2160): n is a, c, g, or t
  misc_feature (2164)..(2164): n is a, c, g, or t
  misc_feature (2174)..(2174): n is a, c, g, or t
  misc_feature (2187)..(2187): n is a, c, g, or t
  misc_feature (2194)..(2194): n is a, c, g, or t
  misc_feature (2214)..(2214): n is a, c, g, or t
  misc_feature (2216)..(2216): n is a, c, g, or t
  misc_feature (2220)..(2220): n is a, c, g, or t
  misc_feature (2237)..(2237): n is a, c, g, or t
  misc_feature (2240)..(2240): n is a, c, g, or t
  misc_feature (2266)..(2266): n is a, c, g, or t
  misc_feature (2315)..(2315): n is a, c, g, or t
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggtttcggatttggaagtgaaacaagactttcaaaanttattggcaaagaagattggaagttaatttcttaaagaatggnaaacaattattgaaggcattattggtacaaangctttttgggagggggnanaggtacgacaggattctttanacttcttaattggattggtatacttgggctcttataggaggaggtcttggaaggaagaacacttaataggcatacganacgaggcgaggggaggtcttggctacggcgagggggaaaanactattccttttgtttanattgctggactttagntatacncnanagggaacgaaaggaggattggcnanaggaggtggtgactttacttctatagatctctangttnactcttctanaggcgagaggtcnctaggcnaggccgggaggcgggtttgncnctanacattggaggattctanacnagatggggttaggaccccgaggcggnattctacacttttggttttttttctctttaaaaaaattggaaaagggtnggacacttgggga

SEQ ID NO: 422682 - DNA, 1588 bp, Homo sapiens
cttctccaagagcagtaactgctattactttttcttgggtatcatcaagataatttctatgcatatacagttattttatgtatattgttttaaacaaatgtgatcataccataaacacagatgagttgcaccttgtttttttttacttggtctctttggcatttttccattttttaatgtatctagacaactacatttttaatgcttacatagtatatttccgttatattaaggaatcataatttatttgaatcacttataaatggatttttttctataaaattggctgtaagccagagtatatcaggtactataaatacatcactaatttgaaacaaataatggctcaggcaatcccgtctggaatatttccagtggtggaatgggttttgctttgggttgcgtgcacgcgcacgcacgtgtgtgtcttcgctttactgtttttctgttctaattttgaggaagaaagattcccagaaataacctgtccagttcagttaaaatatttcattcatgtgagaatgcacacattttagagtgtttagaggtatatctttcaaagtgctttctattatgtttgtgggttaatcgattttaggaatgggttgatttttttgtttgtaattttaaaaaattatttcaaaaacaactacttgtaattaaattattttttcaaaactgtgattttgttaaaatttattttactaatcactagttttaaacgtgatatgactatcttagcttagacatttatttattaaaaggtatgactttttaaacgaaaccttttttgcattagaatttgtgacatttttatatggggttaagtcaggtcacagattaatgtatcttacagttgtctttttctactctttaaaattcatatagtaagaaggttagttgtaaacaccaatgaaatatatatactttgcaagaagacagttttgagagcataggcagtaaagtggaaggaattccattgtttttgacaatcttgcatatctctcattttcccattgtttaatttctaagtggatgttcagtggaggctaacgcctgagagtgctgatgggaaatggtggaaatctggagctacagtagcagtgaacaagaacaccagctaataaagttatcatatcaaagaataaagcctttaccacatgctcactggtggctttcaccctcgggctcctctgagcagtagtaacccaggttgaactcttcaggtattttctggaagaaagcttaattacaaacttttccttgaattacattaggttagaaaacatgcagccaggcacggtggctcatgcctgtaatcccaacactttggaaggctgaggtaggcagatcacttgagcttaggagtttgagaccagcctgggcaacaaggcgaaaccccatctctactaaaaatccaaaattagctgggggtgctcgtgcacacctatagtccccaggtactccggaggctgaggtgggaggatcacctgagcctggggacgtcaaggctccagtgagctgagatcacgccactgcactccagcctggcaacacagtgagacccccatctcaaaaaaaaaaaaaa

SEQ ID NO: 422683 - DNA, 547 bp, Homo sapiens
acagatggagaatcagaatgtcttgaattccatttctcttccggattcctactcttgacatcatagttgatgtgtgcacatcacaatgtttgtgctattcatgcacatctgattctccatctgtcctatatgcgctggcagttttgatcatattacgcctggtcaaggccttcggtgatacctcatcactcttgtctcctcgacctggattttaaggttatttcaactataatggaacctaaccttttccagcttttttttttttttaaaacagctgtcacctgcatacgccagctgaacaacttcctgttcttccaattataatacaagtgaggttttgcagacagggcagggcagcaggagcaaaatcacaaggaaaggtcaagattatatatggcagatgaggataaagtttcaggtgagagtgaaaaaagatgaggtcagcctggaatcttgggtattctagaagagaggggactactgaagaattcttcagcaagagatgtatgtgatggatcagatttagatttacattttaggtagatca

SEQ ID NO: 422684 - DNA, 675 bp, Homo sapiens
gcggagcggagccgtgcggcggggcggggccgggcggcggggcctggtttcctccctcagcgccattttgtggcagcgagacccacaaataaaggggagcgcaggggttgcggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggtaggcgcgggccggctggcgggagcggacgcgggggacctccggggcctgagggctgatgcgcagccgcccccggcgggtaaggggcgggcagggcccgaaaggccacacgggcctggtgcggcaccggtctctcgtgagccgctctaccttcccgcctgcggggaacacttccgccgcttcgaggccattttatctccgtcctccgtccccaaggcccgggttgagaggggtgctctggcggccggagagaccggccactcacggaggccggaggatgccctccccgggctgagcggcggcgctcgttttttcctcgcctcggggtcgcccccttcacctcccttgggcctctcctgaggacctggcggcactaacgagttcagcaaggaaaaaaagaaacattcgttccctacatttcatgtc

SEQ ID NO: 422685 - DNA, 3259 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422686 - DNA, 3485 bp, Homo sapiens
  misc_feature (3416)..(3416): n is a, c, g, or t
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaaaaaaaaaaaaataaaaaaaaataaaaaaaaacataataatattattaataataataaaaaaaaaaaaccttttgggccctttggcccaagtgaattttaaattgggcaaagtttttgaatgcggccgaaatttgggcttggccaatttgcccttagngggggccgtttacaattaattgcccgccttttaacaacggttgaacttggacctggggttcccactttt

SEQ ID NO: 422687 - DNA, 3235 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422688 - DNA, 2158 bp, Homo sapiens
gcggagcggagccgtgcggcggggcggggccgggcggcggggcctggtttcctccctcagcgccattttgtggcagcgagacccacaaataaaggggagcgcaggggttgcggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttcttttcttttctttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaaaaaagcttttttg

SEQ ID NO: 422689 - DNA, 2310 bp, Homo sapiens
cttggcatgttctcagcagaaaaaaccttctctatatatctctttttacctgtttcctgtaaaatgggaaggaataatgagggactattttatgatcagttaaactagatttaggctgggtgtggtgactcaggcctgtaatttcagcagtttgggaggccagggtgtgaggatcatttgagctcgggagttcaagaccagcctgggcaacgtagtgagaccccatctctacaaaaaaatgagccatgtgcctttggtcccagctatacaggaagctgaggcagggacatcgcttgagcccagaccctgtttgcgccacgctgcactccagcctgggggacagagcgagactctgtctaaaaaaaactagatttaaaatgaaaaatccagaagaatgctcagtattactaaaatctgtgagtttatagatatcttctagtttatttaataaactattttatcgtaacaactaatgtatggatttttttttattagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttcttttcttttctttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaaaaaagcttttttg

SEQ ID NO: 422690 - DNA, 2046 bp, Homo sapiens
acagatggagaatcagaatgtcttgaattccatttctcttccggattcctactcttgacatcatagttgatgtgtgcacatcacaatgtttgtgctattcatgcacatctgattctccatctgtcctatatgcgctggcagttttgatcatattacgcctggtcaaggccttcggtgatacctcatcactcttgtctcctcgacctggattttaaggttatttcaactataatggaacctaaccttttccagcttttttttttttttaaaacagctgtcacctgcatacgccagctgaacaacttcctgttcttccaattataatacaagtgaggttttgcagacagggcagggcagcaggagcaaaatcacaaggaaaggtcaagattatatatggcagatgaggataaagtttcagactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttcttttcttttctttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaaaaaagcttttttg

SEQ ID NO: 422691 - DNA, 1733 bp, Homo sapiens
tttgagatgaaaatagatggatttcagaattgattattgatgtaatagaaacaaggtgtagctgtttgggcactttttgtttagggtttatttttgctgctgtgttggcaaaatactgaaatgcagaagatggatgtgtcccagaaaagaagatggtaattatggggaagcatctgctgtgatatagttatgtttgtatgtgttacatctatcactgtaataattgtaagcaaagacagagagttttgtcttcattttgtgatggatggctctttcctttgcagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttcttttcttttctttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaaaaaagcttttttg

SEQ ID NO: 422692 - DNA, 3377 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttcttttcttttctttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgtccccgtacatcgttagaagcttgaattcgagcagtagtagtagtaggcggccgc

SEQ ID NO: 422693 - DNA, 1647 bp, Homo sapiens
acagatggagaatcagaatgtcttgaattccatttctcttccggattcctactcttgacatcatagttgatgtgtgcacatcacaatgtttgtgctattcatgcacatctgattctccatctgtcctatatgcgctggcagttttgatcatattacgcctggtcaaggccttcggtgatacctcatcactcttgtctcctcgacctggattttaaggttatttcaactataatggaacctaaccttttccagcttttttttttttttaaaacagctgtcacctgcatacgccagctgaacaacttcctgttcttccaattataatacaagtgaggttttgcagacagggcagggcagcaggagcaaaatcacaaggaaaggtcaagattatatatggcagatgaggataaagtttcagactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422694 - DNA, 1343 bp, Homo sapiens
ggggaggagcttaatgaaagagttggtaaatcaagtgaatggagggagttttccccaccttcttatgtatgtttcctttgatttggtcgtaattgtttcttttgctttgcacagactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422695 - DNA, 2792 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcagcacaggggcaccccacacgaacgatgacaaacgacggccagcagccaagcgtgaatgacctccagcatacgagctcaagaggagacaacctgcgcaaagtggaggcagcaacaaaagcaatcggcaaatgaatgagacccagactggatactaata

SEQ ID NO: 422696 - DNA, 2728 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatggtaaggggtttgtttctttttggaacgttgtctcaactttgcattggctttttaaaactgccagtcatgaatattataggttagattctgtacattgttaacctctgccctatgattgtatattattgtgagtgaagcatttttagttgagtccgcaaacaaagccatataattttagtttgtttatccccaccctcctaattctttattgttcaaaatttcttacatttttgtttttagttgggggtaggatttggtaaaagataaaagggtgttgtattacttaacaagatggacaaatttgtattcattgtttgaaagggagaataagcatttctcgttaagtgtaaatcttagaaacatg

SEQ ID NO: 422697 - DNA, 2696 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagtggatgttcagtggaggctaacgcctgagagtgctgatgggaaatggtggaaatctggagctacagtagcagtgaacaagaacaccagctaataaagttatcatatcaaagaataaagcctttaccacatgctcactggtggctttcaccctcgggctcctctgagcagtagtaacccaggttgaactcttcaggtattttctggaagaaagcttaattacaaacttttccttgaattacattaggttagaaaacatgcagccaggcacggtggctcatgcctgtaatcccaacactttggaaggctgaggtaggcagatcacttgagcttaggagtttgagaccagcctgggcaacaaggcgaaaccccatctctactaaaaatccaaaattagctggggacgtcaaggctccagtgagctgagatcacgccactgcactccagcctggcaacacagtgagacccccatctcaaaaaaaaaaaaaa

SEQ ID NO: 422698 - DNA, 268 bp, Homo sapiens
acggggatttcataaaattcactagaagtattctgccgtgagtctcatcacagctaattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422699 - DNA, 1759 bp, Homo sapiens
gcggagcggagccgtgcggcggggcggggccgggcggcggggcctggtttcctccctcagcgccattttgtggcagcgagacccacaaataaaggggagcgcaggggttgcggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422700 - DNA, 730 bp, Homo sapiens
gcggagcggagccgtgcggcggggcggggccgggcggcggggcctggtttcctccctcagcgccattttgtggcagcgagacccacaaataaaggggagcgcaggggttgcggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggtatgggttttggttttgggtttttttgttttgttttgggttttttgggggcttttttaagcactttaaaaaaaaatagacttgaagggattatcgttgtttgcttatttttcatttctttgcctttataacaataatagcattggagttgtacagtgtgccagatattgtatcttatatccagtatattttttagaatattttcagattttggaaaactttagttataataatattcccatggtctactcttaatgttcattatgtgaatatttccaggtctactcttaatgttcattatgtaaatatttccaggtacatatatacaaataatgtcaaaaatggacattatgagtatattattattcttttcctagtgtaaatccctttgattgtaattaaaaactactttattaaaaaaatggttatagctaattttcaaa

SEQ ID NO: 422701 - DNA, 3381 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaatagttggtttttttttttttttaagttcaaagaatattatgatgattttgttgtactctttaacattttaatttggggcggggagggcctgttgagagcagattcattttggaaatactgtt

SEQ ID NO: 422702 - DNA, 3135 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422703 - DNA, 1798 bp, Homo sapiens
agttcgacggagactctcttaggcagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttcttttcttttctttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaaaaaagcttttttg

SEQ ID NO: 422704 - DNA, 1543 bp, Homo sapiens
  misc_feature (22)..(22): n is a, c, g, or t
tccgacggcagtacccgcgtanggtagcgaggctgggtggcgtgaccaacgaagaagctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422705 - DNA, 3604 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttcttttcttttctttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcattttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaaaaaagcttttttg

SEQ ID NO: 422706 - DNA, 3039 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaa

SEQ ID NO: 422707 - DNA, 2765 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagtggatgttcagtggaggctaacgcctgagagtgctgatgggaaatggtggaaatctggagctacagtagcagtgaacaagaacaccagctaataaagttatcatatcaaagaataaagcctttaccacatgctcactggtggctttcaccctcgggctcctctgagcagtagtaacccaggttgaactcttcaggtattttctggaagaaagcttaattacaaacttttccttgaattacattaggttagaaaacatgcagccaggcacggtggctcatgcctgtaatcccaacactttggaaggctgaggtaggcagatcacttgagcttaggagtttgagaccagcctgggcaacaaggcgaaaccccatctctactaaaaatccaaaattagctgggggtgctcgtgcacacctatagtccccaggtactccggaggctgaggtgggaggatcacctgagcctggggacgtcaaggctccagtgagctgagatcacgccactgcactccagcctggcaacacagtgagacccccatctcaaaaaaaaaaaaaa

SEQ ID NO: 422708 - DNA, 1219 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaa

SEQ ID NO: 422709 - DNA, 730 bp, Homo sapiens
tggagaggcctccaggttcacacaactggaacccatctccaggaacaaacagctggaacccatctcccgttgaagggaaactgccagatttttgagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaa

SEQ ID NO: 422710 - DNA, 1179 bp, Homo sapiens
tggagaggcctccaggttcacacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaaaaaaaaaaaaaaaaaaaaaaaacgaaaatttttgttggggcgcgcgccttgggcctgagaaaaaaagtgtttcttatagaaacaccttttgcgtgttggggcggcgcgcgggggcgccaagtatgtgtataatgtgtaaacattgtggggcacatatagcgtgtgtcctctatataggagagatctcctggggcacattcgagagtatagtgtcgcttgggagttttctctttcaaccaaataaaaaaaaagcgcgccgggggggaggcaacacgcagacgtgttttttgtagaacaaaatcttccaagagatgggagagtgtctcgagaaggagtcaattaacgtggggattttataatctaataaagggagaggttccaagggaagacgtctgaaatttattaatattttactggccggggtgtggag

SEQ ID NO: 422711 - DNA, 1824 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacc

SEQ ID NO: 422712 - DNA, 771 bp, Homo sapiens
tggagaggcctccaggttcacacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaataagaatcagagtcttctcact

SEQ ID NO: 422713 - DNA, 1154 bp, Homo sapiens
gggtataaaaatttattatacataaaggatattaccactaacaaatgcagacaggctaggacatggtactgggtggaggacggctagctctttggaaagtgaaaggtttgggtggcgtgggcctcatgccacactgattggtcagtagacagggggcacatgccaaacaccacagggcatcagatgctgctctgtgtgctcacaagtgttccctgtcttatctgggccttcgaagggagcacacccagaagcgagcaactgaagcgaaggggcttcctaaggtgccccttccaggcttgtctctgaagtcacagcaacactgttttaagcagtatgtttaattggatgatttccacaaactatccacgaagtttctaaccatcacaattcagtgaagtacaaaacactgagttacaggctgtgggaagagaaggcagcaccaatggtggcaccttctaatactggttgttctaggggcagggagagggaaaggtctttttttaaaccaagcccctcatttcaatgtacaaaagaattactctgatcgatattaaatcgtattgaaaacaaaatggactaaaaagcaaatactactctatgttggggtggaagtgggaggaaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtaccaaaaaattgggtgtgaggagttcagttatatgtttgggattttttaggtagtgggtgttgagcttgaacgctttcttaattggtggctgcttttaggcctactatgggtgttaaattttttactctctctacaaggttttttcctagtgtccaaagagctgttcctctttg

SEQ ID NO: 422714 - DNA, 764 bp, Homo sapiens
tggagaggcctccaggttcacacaactggaacccatctccaggaacaaacagctggaacccatctcccgttgaagggaaactgccagatttttgagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaataaaaaacacaacgcacacataatacaatcaaaa

SEQ ID NO: 422715 - DNA, 1762 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacc

SEQ ID NO: 422716 - DNA, 1928 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacc

SEQ ID NO: 422717 - DNA, 1354 bp, Homo sapiens
tggagaggcctccaggttcacacaactggaacccatctccaggaacaaacagctggaacccatctcccgttgaagggaaactgccagatttttgtaagattcttcctcctgggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacc

SEQ ID NO: 422718 - DNA, 620 bp, Homo sapiens
tggagaggcctccaggttcacacaactggaacccatctccaggaacaaacagctggaacccatctcccgttgaagggaaactgccagatttttgtaagattcttcctcctggtatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaa

SEQ ID NO: 422719 - DNA, 1267 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagcaacctgtggactagtagccaaccgtggactagtagccaaccgtggactagtagccaaccgtgtcctagttgtcaccaggggtcgtagttggttaccagggtcgtagtttgtaacca

SEQ ID NO: 422720 - DNA, 749 bp, Homo sapiens
tggagaggcctccaggttcacacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaa

SEQ ID NO: 422721 - DNA, 1649 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaaaaaaaaaaaaaaaaaaaaaaaacgaaaatttttgttggggcgcgcgccttgggcctgagaaaaaaagtgtttcttatagaaacaccttttgcgtgttggggcggcgcgcgggggcgccaagtatgtgtataatgtgtaaacattgtggggcacatatagcgtgtgtcctctatataggagagatctcctggggcacattcgagagtatagtgtcgcttgggagttttctctttcaaccaaataaaaaaaaagcgcgccgggggggaggcaacacgcagacgtgttttttgtagaacaaaatcttccaagagatgggagagtgtctcgagaaggagtcaattaacgtggggattttataatctaataaagggagaggttccaagggaagacgtctgaaatttattaatattttactggccggggtgtggag

SEQ ID NO: 422722 - DNA, 1160 bp, Homo sapiens
tggagaggcctccaggttcacacaactggaacccatctccaggaacaaacagctggaacccatctcccgttgaagggaaactgccagatttttgagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaaaaaaaaaaaaaaaaaaaaaaaacgaaaatttttgttggggcgcgcgccttgggcctgagaaaaaaagtgtttcttatagaaacaccttttgcgtgttggggcggcgcgcgggggcgccaagtatgtgtataatgtgtaaacattgtggggcacatatagcgtgtgtcctctatataggagagatctcctggggcacattcgagagtatagtgtcgcttgggagttttctctttcaaccaaataaaaaaaaagcgcgccgggggggaggcaacacgcagacgtgttttttgtagaacaaaatcttccaagagatgggagagtgtctcgagaaggagtcaattaacgtggggattttataatctaataaagggagaggttccaagggaagacgtctgaaatttattaatattttactggccggggtgtggag

SEQ ID NO: 422723 - DNA, 731 bp, Homo sapiens
atgatgccgtgtcagagagcaaagctcctgtccttttggcctaatttggtgatgctgttcttgggtctaccacacctccttttgccctccgcaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaa

SEQ ID NO: 422724 - DNA, 1161 bp, Homo sapiens
atgatgccgtgtcagagagcaaagctcctgtccttttggcctaatttggtgatgctgttcttgggtctaccacacctccttttgccctccgcaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaaaaaaaaaaaaaaaaaaaaaaaacgaaaatttttgttggggcgcgcgccttgggcctgagaaaaaaagtgtttcttatagaaacaccttttgcgtgttggggcggcgcgcgggggcgccaagtatgtgtataatgtgtaaacattgtggggcacatatagcgtgtgtcctctatataggagagatctcctggggcacattcgagagtatagtgtcgcttgggagttttctctttcaaccaaataaaaaaaaagcgcgccgggggggaggcaacacgcagacgtgttttttgtagaacaaaatcttccaagagatgggagagtgtctcgagaaggagtcaattaacgtggggattttataatctaataaagggagaggttccaagggaagacgtctgaaatttattaatattttactggccggggtgtggag

SEQ ID NO: 422725 - DNA, 828 bp, Homo sapiens
tggagaggcctccaggttcacacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaaggatctgaccttgttctgtgcacctggctactcactgctattcgagaacaacacactggtgtcctctgcaactccttctcggtcagccggttcgatacggtgtataaccaagtgattgacagtaacatatcgtgggctttcctctcggacgcgcagcacacccaggccaccacgcgcatccgcgacgctccaccccgcgcgt

SEQ ID NO: 422726 - DNA, 1995 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtaccaaaaaattgggtgtgaggagttcagttatatgtttgggattttttaggtagtgggtgttgagcttgaacgctttcttaattggtggctgcttttaggcctactatgggtgttaaattttttactctctctacaaggttttttcctagtgtccaaagagctgttcctctttg

SEQ ID NO: 422727 - DNA, 1778 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacc

SEQ ID NO: 422728 - DNA, 1166 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaa

SEQ ID NO: 422729 - DNA, 417 bp, Homo sapiens
ggacatttgggttggttccaagtctttgctattgtgaatagtaccgcaataaacatacgtgtgcatgtgtctgcctgacaaaaaaaaggccaaaactatttggcccacctctgcaactgaaaccacagttccttcccattcacaaaggctgtatttccctttatttttcttgctctccattgtgctccttttttcaaaaaaaaaaactcatctgagggcaagatcaggagcctcttgcggccacagaaacacccaaagtgcctgcaccaatacagactttcacaaacatcaaatatgagaggaattaaaaaaatgagatttttttccatttggtctttactgaatcttcagtcattttaggcacatgacattacttatttgtgtcaattcttacctcctttccctcaaaccttttcc

SEQ ID NO: 422730 - DNA, 1172 bp, Homo sapiens
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccgggtaagatgctcccagcaattgtcccacatcttaaaggttcttcatgtttatttgatttttctactttggctcacctctgggaaggtagaggcaactagagtgattcctccct

SEQ ID NO: 422731 - DNA, 3440 bp, Homo sapiens
  misc_feature (3417)..(3417): n is a, c, g, or t
  misc_feature (3419)..(3419): n is a, c, g, or t
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcagcacctntnaggggggatcctctatagacc

SEQ ID NO: 422732 - DNA, 3087 bp, Homo sapiens
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagta

SEQ ID NO: 422733 - DNA, 3896 bp, Homo sapiens
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagaggtagaacatgtctttaacttcacagtataaacatgaaggaaatgaggggataggtctctcgttttctgctttcagtggtttgttttgctgagatgttgggggaaatgtttttgaaggctctaccattcaagaagagttgctggcagtagttttggttcctttgtaagtatgaatggagctaagtgagttttccagtcaggaaagaatcatggcattcctggtataaccatgtagttacatatcatagaaaaaaattcagtagaaagtcctctgcctgatttcatcctattaccgaatgaattcaccttccttctgggcagttaaaatggagaaatgacagttataagaggagtagaatgcttcagatttgacctttctgctcttaatttgcctttcagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcagcacctcttttcacctcaactatacagcctctgaactctcaaattacacagtaaattcaaaaaaatatataggaatttggaagaagaa

SEQ ID NO: 422734 - DNA, 2662 bp, Homo sapiens
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcagcacctcttttcacctcaactatacagcctctgaactctcaaattacacagtaaattcaaaaaaatatataggaatttggaagaagaa

SEQ ID NO: 422735 - DNA, 2016 bp, Homo sapiens
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacaggtgaatatcactgttctgtggcccatactgccatcactaaagtagatgtttgattggttggtccccaggacctcagtaaaaatctggcatttaggccatgcgcagtggctcacaccttaaggctgaggcaggagaattgcttaaacccgggaaatggaggttgtggtgagccgagattgcacactgcactccagcttgggtgacagagcaagactccgtcttgaaagaacaaaaaaaaaaatctggcatttaacccccaagatggtttaagagtcaaggtaacctagtgtgaaaatgaagtaagtggaagatttcattcttaggccttttcttactaaaggagttatgtccgttttttcttacctgttaactttggatcttgatttttgtctatagcctagtgaccactatttcctagctccatttattccagaaagatccagcctacctcctacatgataaattaacaatgaactaaatataatattcttggcagttcgttggttcttagcaaacagccacaggggagaggaaagtgaggttctgtctagcagtattaccacggagatgtctcctcgcaatagcatcatcctttacctagaatgtattttccaactacaacagtttttaaaaatgtgtttatgtgattgttttccaaaaaaaaaaaacttcggaagc

SEQ ID NO: 422736 - DNA, 963 bp, Homo sapiens
tgacccagagagcaaggtggctgaactatagtctggaagccctcaggtaaagaggcacatctcaccactcattggttcatatgtagtcctgaagcatgtaccatgttatggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcagcacctcttttcacctcaactatacagcctctgaactctcaaattacacagtaaattcaaaaaaatatataggaatttggaagaagaa

SEQ ID NO: 422737 - DNA, 3498 bp, Homo sapiens
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcagcacctcttttcacctcaactatacagcctctgaactctcaaattacacagtaaattcaaaaaaatatataggaatttggaagaagaa

SEQ ID NO: 422738 - DNA, 3150 bp, Homo sapiens
  misc_feature (62)..(62): n is a, c, g, or t
tcgttctttgataggggggagtgtcgggttcgctggggctcgcgggtcagagccaggatggnttcctcgggagctcttccacgcagcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcagcacctcttttcacctcaactatacagcctctgaactctcaaattacacagtaaattcaaaaaaatatataggaatttggaagaagaa

SEQ ID NO: 422739 - DNA, 3839 bp, Homo sapiens
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaacttcacagtataaacatgaaggaaatgaggggataggtctctcgttttctgctttcagtggtttgttttgctgagatgttgggggaaatgtttttgaaggctctaccattcaagaagagttgctggcagtagttttggttcctttgtaagtatgaatggagctaagtgagttttccagtcaggaaagaatcatggcattcctggtataaccatgtagttacatatcatagaaaaaaattcagtagaaagtcctctgcctgatttcatcctattaccgaatgaattcaccttccttctgggcagttaaaatggagaaatgacagttataagaggagtagaatgcttcagatttgacctttctgctcttaatttgcctttcagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcagcacctcttttcacctcaactatacagcctctgaactctcaaattacacagtaaattcaaaaaaatatataggaatttggaagaagaa

SEQ ID NO: 422740 - DNA, 2466 bp, Homo sapiens
  misc_feature (2443)..(2443): n is a, c, g, or t
  misc_feature (2445)..(2445): n is a, c, g, or t
cgctccagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcagcacctntnaggggggatcctctatagacc

SEQ ID NO: 422741 - DNA, 371 bp, Homo sapiens
ggaggaattaatttaattacactttgtaatgtgttccctcttataaaatctccagagtgagattttcctttatatggaatcatctgcatttaaaaaaaaacttcgtaaaacatgcaaagagcagctgcctatatttgcagctgcaagacagacatttttactacacagtttctgcttgaaccatgacaggtgaagtttaaaaggattcattctaggcaaagtggttagtctttaaaaagttttgttgttgttgttcttgttttatttctagcccaatcaagcatcctttttggaaagttctttctccagtttcagaaatgtagagcctagttatgcttctcattcctcctaatacaaaagatgtttgtatt

SEQ ID NO: 422742 - DNA, 268 bp, Homo sapiens
ctaaagtcataatctagtatgcatagattgtaaacttttagaaattagaaacttgaaaacctacacttttgctttggtgattttacaggtttgtacaaacataattgagaaaaatgcaaacccagagtggaatcaggtcgtcaatcttcagatcaagtttccttcagtgtgtgaaaaaataaaactaacaatatatgactggtgagttgaaaatacgtatgtgtctaattcaacataaaataaacattggatattgtgaaacattact

SEQ ID NO: 422743 - DNA, 6621 bp, Homo sapiens
cggctcacacaggcgggtgccccttggggatgaggcctccaaaggaaggatcaggcagcaatatttgctgttctgctatatttgctgttctgcagcctccattggtgatatccaggcaaacaagatctggaatggacctccagcaaactccaacagacctgccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 422744 - DNA, 877 bp, Homo sapiens
taaacttcatgttcctggggtctccatatctatgtgacctgttatatggtttgccctcttcctcacgggacatgtgcacgagcagctgacagaaaaggaggaagaaatcgtggactggtggagtaaattttatgcttcctcaggggaacatgaaaaatgcggacagtatattcagaaaggctattccaagctcaaggtacctggatctatgctgctatgggtggagaatcaacatcctttgaaactggccacaggaagagctaagaggatgactaaaaggtcccttgggtgggtgctaatgagcagggcccaggaaaacctctgtcttcccggagagccctcttgcatgagtttcggctttgccaagattccagggacttgaggacagctattgagttatggttacgtgactgccacattggggcttggaggcatctggcagatggttgggaatgggctggcaccacactaattaggccacgatgatccagtttgactcagggaaacccagaagtcatagtgctctttgcagaatgacacaagatgtcaacatgctttgttgtgtactttgaacagggattggtttcacaagctgaaaagttgaatctgtcacatgtatgcagcataaaatcacagccgtgagaacatgtatacagcaggaagacaagcgactgagctaggcacggctgactagctctgagctttctgttcatgttttgaattttctaattcttcattcaattttcagcctgtagtgtcctcaagcagaagcagtgctaaagttttcagaacagtgtatatgagaaaaaaaaactttagaatgagaaatatctggtcattgaaataattttccccatcaaagcaaaaaaaaaaaaaa

SEQ ID NO: 422745 - DNA, 170 bp, Homo sapiens
tccatgccccgctcccttctaagccaatagcagatgtggctaatccatcacagcactttttcccaatgactgcttttattccaaaaaagctgcaaacaccgagccacctagactagtttatcaaacttggcacttagagtgaagcctgttcacatgcctacaacttcttg

SEQ ID NO: 422746 - DNA, 6864 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 422747 - DNA, 6825 bp, Homo sapiens
atgatcaccttggtgcttggcaagaaaatgaggagagtttctcttctgccattagggtggaaagagcagttgtgaattaggaggctcaagcaggaaacagtacaaatagatcacgagcagatctctagagagaagatctgcagtgggagggatggagttgaagcttgtcattgcaagactgcagtgttccgtgatgtttcttcctttttccatcctaacactaatgagaactcagcaatccctggctgggtccaacggtgccatctcctctcattgtccctgtgatctctgccattctcttggtctcttcgaaggcaacctgagcaacagccccgatgtactgtgaacacattttcctaaagaatttttccaagtcacaagaagtcccaagtcagtgtcaccaagaggatctccttcacctgccactttaggaacacttaaaacataatggcagacaaaaccgtgtcctggaaacctgagcctttggacatttacaggataagggctatccctcactgggtttctttctgatattttaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 422748 - DNA, 7449 bp, Homo sapiens
  misc_feature (37)..(37): n is a, c, g, or t
  misc_feature (5146)..(5146): n is a, c, g, or t
  misc_feature (5149)..(5151): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagagtatgtactgatttaatcttgccccagaattgttgattatgtgtgtgatgaaatgtgttaaaaatcaaactttaatagtgattcgtgtccctatcgtatgtttttcttctgaaagggcttcatgggcttattttcattcattctggcccagttgaaagctacctgagcaggctcatggcacagctagttggttgctgatcatgttccttgttgagtacctgcctttggcccatttgactctctctcttgctattctatatcttctctttattctagaggatgctaaagagatatgagcagtcagcacttccaaccccttttatcccaaatgaaaatgtgaactgttattatcaaatcaaggtgtttgctatccactaatttttgtattttcaatagagaaggggtttcaccatgttgaccaggatggccttgctcttctgacctcatgatccaccagccttggcctctcaaagtcctgggattacaggcatgagccactgcgcctagcctgttgcaactattttgatgtataagagaacttttaaaattttgccaaatttctgggaattgaatttaatttctgctgtataactattaccttccagtggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaagtgcttaagcagtatgtcaacagcactcagcaaaatggcttctccagcgacagtgcatntgnnngaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 422749 - DNA, 6683 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattaagcctttgcaagggatcctcta

SEQ ID NO: 422750 - DNA, 6850 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgcctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 422751 - DNA, 4863 bp, Homo sapiens
  misc_feature (37)..(37): n is a, c, g, or t
  misc_feature (4851)..(4851): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccgatatgcagggatcctcnagatcgcctcac

SEQ ID NO: 422752 - DNA, 5497 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggagctgatcagtggatgctgtcagttttatcttctatgcttagatgtctaagcatttggtgaattcagtcaaacaacagtttgttgcaattataatcatcagccaatccatttattgaggactgagtacagacaagagtctaaatcttgcactcatcaacagttatgatgacattgtgtagactagtagtcttcaaccctcactaataagtcacccagaatacttaaaataaaacccatgcccaggccccacctcccaagagggagagggacctagatatcagtatgtttttaaatctcctcaaatgattttaatatgctggcaggtctgagaaccacaggtgtggacagtctgagaaagatcatttgctagaaagcgaagtctgagaagcaaatttatagcattgcaacattcagatcagagataacatgcaacacgccagattcttccccctacataaagcagaattgtttgataaatttctaatgaccatatttatcagtgtatgggacacccaggtttttattttcactgtggttttgaagtgaagaaattggttgaaataatcactcaaggccctattttagaactagctattccagccacttctacacgaaggaaagggggcaaaaagcctcagcccagaaaaaaggaaacaccaaatatctccctgtttctcttggcagttatgatgaacattcacagcgtgttttaatgtgcaaactagcccaaaaatgcacatgattgcactttaatatgttatgtccataaacagtgccttaaaaaaaaaatctacttccatcccactgcattaaactcactaacaactggaccatataaaatatagtctccacagccagcactgtgcagcagtgtgtttgattctactctctgtgaatcctacacagtcacaaacgacaatatcaaatttccaatctcatgggccaaaactactgtgatcactttgtaaaccac

SEQ ID NO: 422753 - DNA, 1585 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactggtgagttgaaaatacgtatgtgtctaattcaacataaaataaacattggatattgtgaaacattact

SEQ ID NO: 422754 - DNA, 949 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggtaagctgacccttctgaaggcccagccacccccagggggaggctgctaaagacacacaggagagtgtctggagaaaccctgccattgatcacaagcctgtagctccctgcccacccagacaggggccccgagaggcaggtggggctgcctgaattgggacattgcaattgtttatgaaatgcccttcaaggtagaggggaagggtgaaccaaccctttactgaacaacctcacggtgagcacaaaaagcacatgccggctccagcagaatgtcccagggctttgcttcaggtttgtggcttccaccccatacagtgtctccaggctgtttg

SEQ ID NO: 422755 - DNA, 918 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaagggttccatgagccagatccgaattgaggctggagtgagtgcctgtgagccaggggtggccattctgccctaagttccatgcggacagccaggctgtgaagctgaatctagctgagattagactacacagacctctgagaccaatttcaactctgagacttgatgattcttccaaacagtcctccaaacagaacagatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgtaaacacgggagaacgaaacaaacatgaggacgtcggcgcggacccggcccggccggacggcggtaccaacagcatgttt

SEQ ID NO: 422756 - DNA, 416 bp, Homo sapiens
tcatcgaaaccctcaggcagtgacttaagtggttaagtgaaaaaaaaaatgctgaaacaaatcacccctcttcataatgaaacatgttttttttaatcagggtttgatgactcatcaaaccctcacagctcccaagggcatcttgtttggcagtgccttgtaaatgcactgctcgtcaactggttagtgaaaaagtcaaatcctaatatgcgtggtgaatagggtttcgatgacctcatcgaaaccctaagccggatcctattgtgtctgtcatttttaaggatgagaaaaagaaaacaaagaaagttgataatgaattgaaccctgtctggaatgagatttaggagtttgacttgtctttctttactgtgataatgcatacattttgctttattgctttcatcttattcaatgga

SEQ ID NO: 422757 - DNA, 272 bp, Homo sapiens
ataatgggggcatggaagggttagccaggtagttcatggtggcagtgccaggatttgacccaggcagtctggctgacagctcacgctcttaagcacggagctccttgcctggcacatgagtaactgaactattgcgagtcctctgggctgtgtggcagagagaatctggactggtccatctggggaatttttctcaaagctgccctcgtctggtcttgagaaatgaaacctacctttgtgacccccagttcttgcccaaggaggaattgtac

SEQ ID NO: 422758 - DNA, 413 bp, Homo sapiens
tgttcacatgcctacaacttcttggtcaactgcacttcctacctctggcagtttatctgaactgtagtgatattggatacaacccaaatcacttcttctgattatttgtggcctatacatgtctcattcaagttttactttcagccccatttccatgttaatgtctccttcgccttttaatcccaacagacctaaacagaccttaatccttgccttactgcctctttcctttcacatggggaagggtcacggtggtgcccgtggtgacactgagggttgtcctctgagtaaaattgggagacttcccaaacaggttcccgtgggacagaatgatcttagtattaataaattcaccctagtcctggatctggactttggccttgtagacccagtcgtatgttaccaattcaaac

SEQ ID NO: 422759 - DNA, 596 bp, Homo sapiens
gaaatgagtgacatctacgtcaaagggtaaggttagcatgtgagagactttgccaagctcagggaaacagactctctccttcgtgagttttcattactgaatatgcccaagataggattcttggttttttgaggttattttatctcattaatgtgatctacttaggtagctcctggaaagcaaaggagagagagcaagacctgtacagactttgtttatgaggaaagctatataaggattataagaactgataaatatttctttgtttcctttttgacaaaatggattttcttcagtttcttaagcagatgtattatttctgggacgttttagccatgtagtttctttttattcctctttgataccctgaataactagccttagaaacacaagtaaagctcccaaaatttcattttctacatattttattaccagcagcccatgtctatggaaaagaggaaatgttcgcagatttcaaaggaagtaatttattctcccaacctgcactgagtgccagcatccaacatgtcaagtgtcattgttgttcaatattctcttacttgcctaattcaattaaatcgtctctgtggatggct

SEQ ID NO: 422760 - DNA, 404 bp, Homo sapiens
taacataacttgtttaacaagtggtctactgaaagacttgtgtactgttttcatttcttcccctccatttcaatcaatgctgccaggaacatcctagtgcttctatctttgctcacttgtatgagtgcaagaggaacagctgggtccaagaacattctcccctgtcatttaattcagcactaattattaggtgtagaattgcgtctcctagaaatccacatgtaaataagaacaaatggcctttcactgaaccttatgtctgctcatactttatagaaataccagcgaaggcggaagtacagcctgtctgccgtgtttcattcagccaccatgttgcaagatgttggtgaggccattcagtttgaagtcagcattgggaactatggcaacaagtttgacaccac

SEQ ID NO: 422761 - DNA, 536 bp, Homo sapiens
ggtttagaatttaatcatttctgcataacttcaaaagattgtcattggtgaaaataatgacccaacatgtagtactggtgcatcttagtgtaatctctgctccttctaacagcctttttttttctcttttttcaaaacctttctgtgaacagattttggagtttgacttgaggggtataccactggacttttcatcttcccttgggattattgtgaaagattttgagacaattggacaaaataagtaagttgttttcacctgtttttctcattttaggtattactatctcactgttgtttattttgttgaagagacacatctttaataacgtattataatacttccaatataaatgtgctttaattccatgccccgctcccttctaagccaatagcagatgtggctaatccatcacagcactttttcccaatgactgcttttattccaaaaaagctgcaaacaccgagccacctagactagtttatcaaacttggcacttagagtgaagcctgttcacatgcctacaacttcttgg

SEQ ID NO: 422762 - DNA, 419 bp, Homo sapiens
tcatcagtaaatgcctaggaatgcaatctctagatcatagaataggtggctacttaactccaaaagaaactaccagacattttccaaagtggttgtatctgtctacactcccgccagcgatttgggagttccggtcgccccatccacaacctcaggcccacttgatactgtcagcccttttgattttagaccttacctgcattttaatgagaaattaagactctgttggtggttttcagatatataattgtgaactagaaaatgtagcagaatttgagggcctgacagacttctcagatacgttcaagttgtaccgaggcaagtcggatgaaaatgaagatccttctgtggttggagagtttaaggtgagtaagatgtgtgttggtcccgtttaaaatccaccttcattttctatatag

SEQ ID NO: 422763 - DNA, 6903 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 422764 - DNA, 6913 bp, Homo sapiens
tcatcgaaaccctcaggcagtgacttaagtggttaagtgaaaaaaaaaatgctgaaacaaatcacccctcttcataatgaaacatgttttttttaatcagggtttgatgactcatcaaaccctcacagctcccaagggcatcttgtttggcagtgccttgtaaatgcactgctcgtcaactggttagtgaaaaagtcaaatcctaatatgcgtggtgaatagggtttcgatgacctcatcgaaaccctaagccggatcctattgtgtctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 422765 - DNA, 6883 bp, Homo sapiens
  misc_feature (37)..(37): n is a, c, g, or t
  misc_feature (4580)..(4580): n is a, c, g, or t
  misc_feature (4583)..(4585): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaagtgcttaagcagtatgtcaacagcactcagcaaaatggcttctccagcgacagtgcatntgnnngaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 422766 - DNA, 7069 bp, Homo sapiens
  misc_feature (37)..(37): n is a, c, g, or t
  misc_feature (6894)..(6894): n is a, c, g, or t
  misc_feature (6934)..(6934): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttaatttccagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttttacattaaagcagttaaggacataatgttnaattgtgctaatacgtacaataatgatatatgaataacancctccgcccctttggccccagcgggggagcctttgcgtgcctttccttttagaggagggaaatataaggaccactgctccccaacatctcgggacagggtctggggcttgtggcgagggctatctccacattcag

SEQ ID NO: 422767 - DNA, 5302 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaaggtacctggatctatgctgctatgggtggagaatcaacatcctttgaaactggccacaggaagagctaagaggatgactaaaaggtcccttgggtgggtgctaatgagcagggcccaggaaaacctctgtcttcccggagagccctcttgcatgagtttcggctttgccaagattccagggacttgaggacagctattgagttatggttacgtgactgccacattggggcttggaggcatctggcagatggttgggaatgggctggcaccacactaattaggccacgatgatccagtttgactcagggaaacccagaagtcatagtgctctttgcagaatgacacaagatgtcaacatgctttgttgtgtactttgaacagggattggtttcacaagctgaaaagttgaatctgtcacatgtatgcagcataaaatcacagccgtgagaacatgtatacagcaggaagacaagcgactgagctaggcacggctgactagctctgagctttctgttcatgttttgaattttctaattcttcattcaattttcagcctgtagtgtcctcaagcagaagcagtgctaaagttttcagaacagtgtatatgagaaaaaaaaactttagaatgagaaatatctggtcattgaaataattttccccatcaaagcaaaaaaaaaaaaaa

SEQ ID NO: 422768 - DNA, 3841 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgcgttccttgcagacatctgagtttcacttcactttcataggtgtgtgcctctccagttgccactgcattggcgacagatggtggggacccacaggacacggg

SEQ ID NO: 422769 - DNA, 2045 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagagtatgtactgatttaatcttgccccagaattgttgattatgtgtgtgatgaaatgtgttaaaaatcaaactttaatagtgattcgtgtccctatcgtatgtttttcttctgaaagggcttcatgggcttattttcattcattctggcccagttgaaagctacctgagcaggctcatggcacagctagttggttgctgatcatgttccttgttgagtacctgcctttggcccatttgactctctctcttgctattctatatcttctctttattctagaggatgctaaagagatatgagcagtcagcacttccaaccccttttatcccaaatgaaaatgtgaactgttattatcaaatcaaggtgtttgctatccactaatttttgtattttcaatagagaaggggtttcaccatgttgaccaggatggccttgctcttctgacctcatgatccaccagccttggcctctcaaagtcctgggattacaggcatgagccactgcgcctagcctgttgcaactattttgatgtataagagaacttttaaaattttgccaaatttctgggaattgaatttaatttctgctgtataactattaccttccagtggatgatgccttctcacagacagtaaaggaaatatttggaggcaatgcagataagaaaaatctcgtggatccttttgtagaagtttcctttgctggaaaaaaggtttgtacatgatctaaatgcagatgctgctagta

SEQ ID NO: 422770 - DNA, 724 bp, Homo sapiens
  misc_feature (37)..(37): n is a, c, g, or t
aaatcctcccttcactgggagagaacttctctcccanggcggtgcgacccggagctccagcgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgtaaacacgggagaacgaaacaaacatgaggacgtcggcgcggacccggcccggccggacggcggtaccaacagcatgttt

SEQ ID NO: 422771 - DNA, 755 bp, Homo sapiens
  misc_feature (7)..(7): n is a, c, g, or t
  misc_feature (63)..(63): n is a, c, g, or t
  misc_feature (69)..(69): n is a, c, g, or t
  misc_feature (71)..(71): n is a, c, g, or t
  misc_feature (74)..(74): n is a, c, g, or t
tccagtnacgtaaagtaagtcaccaggtagtcaagtaaagtccgtgtagaacgtggggtggtnaaagtntnagngtgtgtgtagtcagtagtgtaaagtcaggtgtcgtgtggtaggtcttacattttttgttgttgttctggaatctacctgtaaaggaaagtagacctggattcatgtgggctcttccatggcttaagtgttgcccaagagattttgtaggtaacgatttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataaccatactcaagagcttcttagattttcatttatggcaagttataattacatgtaaaagtagtcttgaacaggtaaatattgagcctttttaataggatgtaacctttgtagagcccaaattctaaagaacaaaattggcaatccaattaaactacatgcaaaataagtgtgatacatgcatctacaaaaacagtgttctcattttttctgggtatgcaaatgattggattgtttctccttggatctctgtatgtacaggtaaagaatagtttacagatccctgctgaaatta

SEQ ID NO: 422772 - DNA, 668 bp, Homo sapiens
atgtgttctgagtttcttttattgacgtatttcttctctctatctctcagaaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaagtaagaacttacagtctataaacttagttttatattaaagatggttattttgattgatcttgatatgtttttcatttcatcagtaacaatgaaagtcttctggtagaataatcagttctgtattaaaattattttcttgatatggtagggtttatgtagaaccttccatattctcctgtcacctgtgatctgtagatattgtcaaaatatgaagagcattgcgatggcagaagagttttctgagaaattgactcccctaaatgtgggtatagtatataatatagccaaccgagatcatttatgttttgaatacttgttttctgaattgaaaagacatcttctcccactttttgtta

SEQ ID NO: 422773 - DNA, 620 bp, Homo sapiens
gggcggggatgagtgcagctgggctcagctccccgtgccctacctttctgttctcttccttggtttcccctactctcctcctgccccaagcagtgcctgatgccgagttccgtctctcgcgtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacaggtaattcatttttcacattataagaggaacaagtacatactgatcatctctgaaaataagtatcttatttaatccttgaataaacctctatgaaatgggtattattttatactatttaacagataatactaaaagctaccatttattatgcaccagcaatctgttaggttctttgcttgtgctatcagtataagctgtacaaagactactcagcacagtccaatagaacttttccacaatcatggaaatttt

SEQ ID NO: 422774 - DNA, 1428 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422775 - DNA, 1594 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422776 - DNA, 2290 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgatatcatagttttttataccttatttaagagaaacaacctgacgtgcaccaatcagtctgcacatcccaacccttcacattttataaattattgtagatcatgttttgttaggagcacttttatgagagacattttccatgactaaataatcagcattagtcagtaaatcctttagaactgggttttgaaatgggagttttatcatattaaatcatttcttgtagtcttacattttttgttgttgttctggaatctacctgtaaaggaaagtagacctggattcatgtgggctcttccatggcttaagtgttgcccaagagattttgtaggtaacgatttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataaccatactcaagagcttcttagattttcatttatggcaagttataattacatgtaaaagtagtcttgaacaggtaaatattgagcctttttaataggatgtaacctttgtagagcccaaattctaaagaacaaaattggcaatccaattaaactacatgcaaaataagtgtgatacatgcatctacaaaaacagtgttctcattttttctgggtatgcaaatgattggattgtttctccttggatctctgtatgtacaggtaaagaatagtttacagatccctgctgaaatta

SEQ ID NO: 422777 - DNA, 1639 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaagtgcctgatgccgagttccgtctctcgcgtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422778 - DNA, 1436 bp, Homo sapiens
gggcggggatgagtgcagctgggctcagctccccgtgccctacctttctgttctcttccttggtttcccctactctcctcctgccccaagcagtgcctgatgccgagttccgtctctcgcgtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422779 - DNA, 1552 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaagtgcctgatgccgagttccgtctctcgcgtcttttcctggtcccaggcaaagcggagcggagatcctcaaacggcctagtgcttcgcgcttccggagaaaatcagcggtctaattaattcctctggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422780 - DNA, 2419 bp, Homo sapiens
ctgtccggtctgatagtccacttctagaactgaatacagttcctaattaaaccctattgaaatttaagtaaaatttaaaaatttggggatacaatgtctactttataatgctgtgtgtgtgtgagacagagtctcgctctactgcccaggctggagtgcagtggcacgacctcagctcactgcaacctctgtctcctgagtagctgggattacaggcgcccgccaccacgcccagctaatttttgtatttttagtagagacagggtgtcaccatgttggccaggatagtctcaatctcctgacctcgtgatccgcccgcctgggcctcccaaagtgctgggattacaggcgagagccaccgcccccggcctgcaagaacatttttataaacattcttactgccctgtgaaatttattcctgcatactctcaattattttgaaaggctttttgaattatgaatcattgaaattctaattttgttggtttggcaattactcagcaatgctttcaggtttcaaaggcaaaaacacattgacaattagtcttcctcacctagtccatgcatttaaattcctcagttgtcattcgcaaactggtaaaccatttcaagccctgcttctataaactgtcagtttaaacaactgggactctcaaagcctaaggagatacgaatccaagataattcgtacatagaaaaaaatcatacataaagttgtactccatacctgtggccttatgactacataattaataaatcagctatcattattatattgtatgcttattctactccactccaaggaacaactgtttgagtactgtaactcagaagctaagtaaattgcctgaaatcatagagttgggtagtagtaaaggtaggacttgtgtttagagatatctcatctcacagctgtgttctttacatcacatggacttgcaattgctttattttgcttaataatctattatttttttcctcatgtctctctataggagaagacgcaatgatatttcttttttcctctttaagatagtgaaggtgttggatgtgagaatgcatatgaaaatttatatcctggaattaaaacattatttaattccagatggtacaacatcattgtaaaaaactcaagtgtcaactcatcaaagaaaaataacctgttaacaatgctgtagcctagtattctgcccatgaacaatattggcgtgttgacttaaaactgtacatgtttaaaattgtgtggattgagagaaaaacttcttattttctttgtgtcggttttaggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422781 - DNA, 1507 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422782 - DNA, 2523 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaatattgtcaaaatatgaagagcattgcgatggcagaagagttttctgagaaattgactcccctaaatggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgatatcatagttttttataccttatttaagagaaacaacctgacgtgcaccaatcagtctgcacatcccaacccttcacattttataaattattgtagatcatgttttgttaggagcacttttatgagagacattttccatgactaaataatcagcattagtcagtaaatcctttagaactgggttttgaaatgggagttttatcatattaaatcatttcttgtagtcttacattttttgttgttgttctggaatctacctgtaaaggaaagtagacctggattcatgtgggctcttccatggcttaagtgttgcccaagagattttgtaggtaacgatttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataaccatactcaagagcttcttagattttcatttatggcaagttataattacatgtaaaagtagtcttgaacaggtaaatattgagcctttttaataggatgtaacctttgtagagcccaaattctaaagaacaaaattggcaatccaattaaactacatgcaaaataagtgtgatacatgcatctacaaaaacagtgttctcattttttctgggtatgcaaatgattggattgtttctccttggatctctgtatgtacaggtaaagaatagtttacagatccctgctgaaatta

SEQ ID NO: 422783 - DNA, 1499 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaagtgcctgatgccgagttccgtctctcgcgtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttataaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422784 - DNA, 1485 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaagtgcctgatgccgagttccgtctctcgcgtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacattgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422785 - DNA, 961 bp, Homo sapiens
tttgtaggagagattcttaggttcacaatcctaaactaaagaatttgaaatatggaattcagattgtacatagtgcctcagtaattgagctaggaacaaaaatgttgagcctgatcatactcacttcaaagaaatgagggatgagtaaatgccctttctgagaaccattatctagttaaagattatgatagaactgctaattttctgagcaaagaggtggggtttgactgtgagaaccattttgttgtgaccctctgagcagcacatttttagttttacagtaccactgctgtgtaacattaagtctttaagaaaatgggtttagaccttagcaataaatgtgtgagtaatccttttagactgtaaagtgatttttgttctctgagatcgtctctgagattcttccttgacttatgtttttatatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422786 - DNA, 1480 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcaggtaagaaggcacaatattagatttattcagtcagacttccttctcttagtccaggaaggtagactaagagaactttccataggcaactctcccgcctttttgaaaattaactgtttgtgatttggtatcataaacaagtgatgtaacttttcaggtgaattgtttctgtgtttaaagaagtagtgtattgctagcaagatttagccttgaaaatggggctataaaataaatttcagaaattcttaca

SEQ ID NO: 422787 - DNA, 1210 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgtcaaaaatagaaatcaggaagataattcaacttaaagaagttcatttcatgaccaaactcttcagaaacatgtctttacaagcatatctcttgtattgctttctacactgttgaattgtctggcaatatttctgcagtggaaaatttgatttagctagttcttgactgataaatatggtaaggtgggcttttccccctgtgtaattggctactatgtcttactgagccaagttgtaatttgaaataaaatgatatgagagtgacacaaaaaaaaacaaaacacaaaaagacaaaaaaagggcgcgggccagctacaaaaagtactccccacgaggggcgcccaaggaattaccggtatacccacgatttctggacacagggtgggccccctaaaggggaggctcggtatatataaggctagggcactgggccccgaccgttcaacaaacggtccggaaacagggcaaacg

SEQ ID NO: 422788 - DNA, 927 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaagtgcctgatgccgagttccgtctctcgcgtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgtaagtaatgaaagtgattttaacatgataatagccaaattgctacagtattttcttctttcaacactggagtgttacttgttttactttctagttatacttgagagtatgttatcactaaataattgatcataattatgctc

SEQ ID NO: 422789 - DNA, 965 bp, Homo sapiens
gggcggggatgagtgcagctgggctcagctccccgtgccctacctttctgttctcttccttggtttcccctactctcctcctgccccaagcagtgcctgatgccgagttccgtctctcgcgtcttttcctggtcccaggcaaagcggagcggagatcctcaaacggcctagtgcttcgcgcttccggagaaaatcagcggtctaattaattcctctggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgtcaaaaatagaaatcaggaagataattcaacttaaagaagttcatttcatgaccaaactcttcagaaacatgtctttacaagcatatctcttgtattgctttctacactgttgaattgtctggcaatatttctgcagtggaaaatttgatttagctagttcttgactgataaatatggtaaggtgggcttttccccctgtgtaattggctactatgtcttactgagccaagttgtaatttgaaataaaatgatatgagagtgacacaaaaaaaaacaaaacacaaaaagacaaaaaaagggcgcgggccagctacaaaaagtactccccacgaggggcgcccaaggaattaccggtatacccacgatttctggacacagggtgggccccctaaaggggaggctcggtatatataaggctagggcactgggccccgaccgttcaacaaacggtccggaaacagggcaaacg

SEQ ID NO: 422790 - DNA, 1168 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaagtgcctgatgccgagttccgtctctcgcgtcttttcctggtcccaggcaaagcggagcggagatcctcaaacggcctagtgcttcgcgcttccggagaaaatcagcggtctaattaattcctctggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgtcaaaaatagaaatcaggaagataattcaacttaaagaagttcatttcatgaccaaactcttcagaaacatgtctttacaagcatatctcttgtattgctttctacactgttgaattgtctggcaatatttctgcagtggaaaatttgatttagctagttcttgactgataaatatggtaaggtgggcttttccccctgtgtaattggctactatgtcttactgagccaagttgtaatttgaaataaaatgatatgagagtgacacaaaaaaaaacaaaacacaaaaagacaaaaaaagggcgcgggccagctacaaaaagtactccccacgaggggcgcccaaggaattaccggtatacccacgatttctggacacagggtgggccccctaaaggggaggctcggtatatataaggctagggcactgggccccgaccgttcaacaaacggtccggaaacagggcaaacg

SEQ ID NO: 422791 - DNA, 1603 bp, Homo sapiens
ctgtccggtctgatagtccacttctagaactgaatacagttcctaattaaaccctattgaaatttaagtaaaatttaaaaatttggggatacaatgtctactttataatgctgtgtgtgtgtgagacagagtctcgctctactgcccaggctggagtgcagtggcacgacctcagctcactgcaacctctgtctcctgagtagctgggattacaggcgcccgccaccacgcccagctaatttttgtatttttagtagagacagggtgtcaccatgttggccaggatagtctcaatctcctgacctcgtgatccgcccgcctgggcctcccaaagtgctgggattacaggcgagagccaccgcccccggcctgcaagaacatttttataaacattcttactgccctgtgaaatttattcctgcatactctcaattattttgaaaggctttttgaattatgaatcattgaaattctaattttgttggtttggcaattactcagcaatgctttcaggtttcaaaggcaaaaacacattgacaattagtcttcctcacctagtccatgcatttaaattcctcagttgtcattcgcaaactggtaaaccatttcaagccctgcttctataaactgtcagtttaaacaactgggactctcaaagcctaaggagatacgaatccaagataattcgtacatagaaaaaaatcatacataaagttgtactccatacctgtggccttatgactacataattaataaatcagctatcattattatattgtatgcttattctactccactccaaggaacaactgtttgagtactgtaactcagaagctaagtaaattgcctgaaatcatagagttgggtagtagtaaaggtaggacttgtgtttagagatatctcatctcacagctgtgttctttacatcacatggacttgcaattgctttattttgcttaataatctattatttttttcctcatgtctctctataggagaagacgcaatgatatttcttttttcctctttaagatagtgaaggtgttggatgtgagaatgcatatgaaaatttatatcctggaattaaaacattatttaattccagatggtacaacatcattgtaaaaaactcaagtgtcaactcatcaaagaaaaataacctgttaacaatgctgtagcctagtattctgcccatgaacaatattggcgtgttgacttaaaactgtacatgtttaaaattgtgtggattgagagaaaaacttcttattttctttgtgtcggttttaggatttacaaaaggtgcaggtatgagcaggtctgaagactaacattttgtgaagttgtaaaacaggtaattcatttttcacattataagaggaacaagtacatactgatcatctctgaaaataagtatcttatttaatccttgaataaacctctatgaaatgggtattattttatactatttaacagataatactaaaagctaccatttattatgcaccagcaatctgttaggttctttgcttgtgctatcagtataagctgtacaaagactactcagcacagtccaatagaacttttccacaatcatggaaatttt

SEQ ID NO: 422792 - DNA, 277 bp, Homo sapiens
gttagaaatgtggtggtttcagcaaggcctcagtttccttccttcagcccttgtaatttggacatctgctgctttcatattttcatacattactgcagtaacactccaccatatagacccggctttaccttatatcaggtaagtgaaatgtattctttgtataggagactctttatgtctcattcttattttaacattgaagtcaacatttaatgtcaaccttttaaaaatcagattttacattggcattacaacaataaagggaatataaaaagga

SEQ ID NO: 422793 - DNA, 1454 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttataaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422794 - DNA, 1352 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatga

SEQ ID NO: 422795 - DNA, 2469 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaatattgtcaaaatatgaagagcattgcgatggcagaagagttttctgagaaattgactcccctaaatggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgatatcatagttttttataccttatttaagagaaacaacctgacgtgcaccaatcagtctgcacatcccaacccttcacattttataaattattgtagatcatgttttgttaggagcacttttatgagagacattttccatgactaaataatcagcattagtcagtaaatcctttagaactgggttttgaaatgggagttttatcatattaaatcatttcttgtagtcttacattttttgttgttgttctggaatctacctgtaaaggaaagtagacctggattcatgtgggctcttccatggcttaagtgttgcccaagagattttgtaggtaacgatttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataaccatactcaagagcttcttagattttcatttatggcaagttataattacatgtaaaagtagtcttgaacaggtaaatattgagcctttttaataggatgtaacctttgtagagcccaaattctaaagaacaaaattggcaatccaattaaactacatgcaaaataagtgtgatacatgcatctacaaaaacagtgttctcattttttctgggtatgcaaatgattggattgtttctccttggatctctgtatgtacaggtaaagaatagtttacagatccctgctgaaatta

SEQ ID NO: 422796 - DNA, 1146 bp, Homo sapiens
ccggtgaccgcgctccgcagccttaccctgaccccaacaagtacacccctagaaatatcgcctccgactccagccgactgggtgactgatcggcggcagcacgttcacgacactttcgcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttataaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaagttatgtgcttcacatgatcactactgcagcccgacatggctcatgctcatacgccttcctgtggctatctcactgacttaaccatccggagattgcacagacaactctcttacagcgtggacagccaattaacatggattgaaac

SEQ ID NO: 422797 - DNA, 787 bp, Homo sapiens
  misc_feature (648)..(648): n is a, c, g, or t
  misc_feature (724)..(724): n is a, c, g, or t
  misc_feature (787)..(787): n is a, c, g, or t
agccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttgaatttgaaaaatccnagtgaaaaagtttggaacagagaagctcctaagcagcttgagaagagcgttcggccaagcaggtttattctgctangcttggtgcagaaagcaccaccaggaaccgaggaagacagaagcagcttaccttgatttgggn

SEQ ID NO: 422798 - DNA, 4872 bp, Homo sapiens
cccctcattcaaaggcacctcccaccccgcacctcagccttggcggagaggactcacagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatctt

SEQ ID NO: 422799 - DNA, 4925 bp, Homo sapiens
agccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatctt

SEQ ID NO: 422800 - DNA, 5066 bp, Homo sapiens
agccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatgccagagctgagagaggaaaccctccacccatcccacccaagaaacctggcctcaccccttctccatctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatctt

SEQ ID NO: 422801 - DNA, 5160 bp, Homo sapiens
cccctcattcaaaggcacctcccaccccgcacctcagccttggcggagaggactcacagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatcttgctgtttggggggaaatagtcttgtttgtacaaagtgaaaaatggcacaatttgggcatattttgttgggaagagggggtggtgtagagggagcacttgactgtggctttgacaaaacaaatgaagtcaatgacccatccaggttagactccataaggaactaagacattgattttctttagagtcttagagctggaaaaagcctttacaataatccagtctgtgattttttaaa

SEQ ID NO: 422802 - DNA, 4065 bp, Homo sapiens
cccctcattcaaaggcacctcccaccccgcacctcagccttggcggagaggactcacagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactagattgtaatgatgtgtaccatataacacaagcattaactaggcattaacgtttgtaaagccaaatataccatgcagaagtcttcatttttatagcagactgcattaaaacaagttaaatctt

SEQ ID NO: 422803 - DNA, 852 bp, Homo sapiens
  misc_feature (19)..(19): n is a, c, g, or t
ggcaactccacagattatnggttgataaaggcaaatacaccattgtgattatacactgatttccatcacctgcctttttactatcaactcttattagataaaaaggcaggtgatggaaatcagtgtataatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatctt

SEQ ID NO: 422804 - DNA, 2961 bp, Homo sapiens
  misc_feature (2706)..(2706): n is a, c, g, or t
agccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggataaggtcagagacggaggcacaagacgtccccaagaggtgagttctgtttcagggagactgacagacaccagtgggtgctttcttcaagggttggggctgacctaagaaggagctcccaggccacagcattctgcaatacactgtccaataatttgtagggaagatctaggaacatgcaaaaggcagtttgaaaaaggacctggttgccaaagtaccatattacccatcaatgtcctctcctacccatttccctttttcacaccctctaaatctctataagcaaatgcggaaaatgcaaactaagctttgaacagaatcaaatgagtccctctgggacacttgcaggggacttatttcttccgaaggatgtgacagcagcttctcccaatagtggcagcgtttgtttcactgttagactggaggagcacaaggagcatacaacatgtggctctgtccacaccactgtgaagttgttggttctgagaaattactggggggagtgttaaaacaagattggccttatctctggggagtcacctgtttaacctgacaagaatcctgctcattaactcaatgtgttagacactaggatgtgccacatgggttccctttcaggagtgaaatttaantccctaggtgcagggaatgctgacagtaagtggccctcaagatataaccccttataggaattaccttcactgaaagaaaatcagcttgaccaaagtcacagctccttccctggacagctcatatattaatacaaagactgggcatggtggctgacacctgtaatcccagcactttgggagactgaggcaggtggatcacttgaggtcaggagttcgagactagcctggtcaacatggtgaaaccacatctctact

SEQ ID NO: 422805 - DNA, 1847 bp, Homo sapiens
agccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatgccagagctgagagaggaaaccctccacccatcccacccaagaaacctggcctcaccccttctccatctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcctctgccctggacctgtgacattctggactatttctgtgtttatttgtggccgagtgtaacaaccatataataaatcacctcttccgctgttttagctgaagaattaaatc

SEQ ID NO: 422806 - DNA, 4925 bp, Homo sapiens
cccctcattcaaaggcacctcccaccccgcacctcagccttggcggagaggactcacagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatctt

SEQ ID NO: 422807 - DNA, 5835 bp, Homo sapiens
cccctcattcaaaggcacctcccaccccgcacctcagccttggcggagaggactcacagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatcttaaaaaaaaaaacaaaaaaaaaaaaaaaaaaaaaaaaaaacaaaaaaaaaaaaaacaagtgtgtggcgcgcgcgcgccgcgccgcggccccccgaaagaggaggactttcaaacaccccatcgcggtgggggggcgcgcgggggcgcccccaggagagggaaggaggacaggaggggggccccgcgcgtgctgtccccacggggagacccgcgcgcggggcaccgagaaaaaacgggtgcgggggggttctccccccccacaaaataaaaaaaacacgccgcgccgggggagaacacacgggaagaggggttttagaaaacacacaaccacagaagaggagaattgcctgagagcgaccgtacagcgggggactaacacaacaacaaggaggacccaaagggtgagagcggcaacgaaataaaaaactaacccccgccgcccggggggggccagaaaagagacctacagatgaaggccatgacaggaaaaagagaaatacacgaagcaacgaccaccaagagagaacacaccagggaacacaaataaacggccaaactaaacacccaaacagagagactaacacagccgggaccacagagccacgccacggaccacaccaccgtccagtctgcattgaagaccgcacagaacagcaattaacccaagcagaggaaccaagcagctatctcaagtcagtgctctacagcaccgacgaccaacacttggtatgggctcgcatagcaccaggcggggggtcgacactccacgacagacgacacggtgcagatacccgaaatacacacctaaactcaatcgaaagacaaacaacaagcacaccaatacctaacgcgcgcacagcaatgcgctacagaaaaccaacagcatgaaaaaatcatcgcgcgcgaacaag

SEQ ID NO: 422808 - DNA, 5026 bp, Homo sapiens
tgagatttcctaggatatttgtttgtaaacgtgtctggaggaaatatgatgaaaaattgatctttgtgagtggtagtgaaatcaataattaaagtgaattttactttctgttgttgcttagtttgtgattaacaccagaaaacatatttctatttaatttcaactatttcctttattaaggcatttgatactataattgctcttatctctcactttattttttctttaattgtatcaaattaactatgtctttggagattgtctgattgttacctttgtttcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatctt

SEQ ID NO: 422809 - DNA, 4300 bp, Homo sapiens
cccctcattcaaaggcacctcccaccccgcacctcagccttggcggagaggactcacagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactagattgtaatgatgtgtaccatataacacaagcattaactaggcattaacgtttgtaaagccaaatataccatgcagaagtcttcatttttatagcagactgcattaaaacaagttaaatcttgctgtttggggggaaatagtcttgtttgtacaaagtgaaaaatggcacaatttgggcatattttgttgggaagagggggtggtgtagagggagcacttgactgtggctttgacaaaacaaatgaagtcaatgacccatccaggttagactccataaggaactaagacattgattttctttagagtcttagagctggaaaaagcctttacaataatccagtctgtgattttttaaa

SEQ ID NO: 422810 - DNA, 2751 bp, Homo sapiens
  misc_feature (2496)..(2496): n is a, c, g, or t
agccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatgcagcctctttgaccactgcagaagaccttgccagcagctgctcttccaatactgttgtagcaaatggataaggtcagagacggaggcacaagacgtccccaagaggtgagttctgtttcagggagactgacagacaccagtgggtgctttcttcaagggttggggctgacctaagaaggagctcccaggccacagcattctgcaatacactgtccaataatttgtagggaagatctaggaacatgcaaaaggcagtttgaaaaaggacctggttgccaaagtaccatattacccatcaatgtcctctcctacccatttccctttttcacaccctctaaatctctataagcaaatgcggaaaatgcaaactaagctttgaacagaatcaaatgagtccctctgggacacttgcaggggacttatttcttccgaaggatgtgacagcagcttctcccaatagtggcagcgtttgtttcactgttagactggaggagcacaaggagcatacaacatgtggctctgtccacaccactgtgaagttgttggttctgagaaattactggggggagtgttaaaacaagattggccttatctctggggagtcacctgtttaacctgacaagaatcctgctcattaactcaatgtgttagacactaggatgtgccacatgggttccctttcaggagtgaaatttaantccctaggtgcagggaatgctgacagtaagtggccctcaagatataaccccttataggaattaccttcactgaaagaaaatcagcttgaccaaagtcacagctccttccctggacagctcatatattaatacaaagactgggcatggtggctgacacctgtaatcccagcactttgggagactgaggcaggtggatcacttgaggtcaggagttcgagactagcctggtcaacatggtgaaaccacatctctact

SEQ ID NO: 422811 - DNA, 762 bp, Homo sapiens
aggggtggcctgaagatagacagagggtggataaataatcatgtaggattcctgagaagatagaagaagttggatccagagcacagcagggggaattagctggccttggagaggagagatgatctctatcctctattctagaaggaagccaaaggtgatgtgtgcagatgcagaggtgtgtttgatgtggtgaagccaagtcaaaggagtttttgttcgatgccttatatctgctccagaaagcagttgagtcaccaactgagacagggagagagaaaggggctggcatactaggaaggaaaggggatcatttcagatatttgaggaggacagagtaagttggaatatgaaagggaataaatgagtgaaatttagtaggactgctagtcactgcttgaaggctcagctgaggctgatgatcatgaattcatggtactactgttagaattattataaaatatatgagcctttttggaggtgctcagcagtttaccagacacagaaaaacaggttcatctaggcttaggattttgtcagagaggtatgatgaaaagattgcaaaggagtttaggatattggcatgggcaagggagcttctggagtgataaaccaggaatctaagcctgctagggagggacatatagacaggagaaggagagtatagagatctttctgaaggttagaggaaatttgtaatcaaagtggttgattaaacaagacagaagtatagcagtcagtgatcagcccaggatgctgcacccc

SEQ ID NO: 422812 - DNA, 1100 bp, Homo sapiens
  misc_feature (947)..(947): n is a, c, g, or t
  misc_feature (950)..(950): n is a, c, g, or t
  misc_feature (952)..(952): n is a, c, g, or t
  misc_feature (957)..(957): n is a, c, g, or t
  misc_feature (966)..(966): n is a, c, g, or t
  misc_feature (969)..(969): n is a, c, g, or t
  misc_feature (972)..(972): n is a, c, g, or t
  misc_feature (979)..(979): n is a, c, g, or t
  misc_feature (989)..(989): n is a, c, g, or t
  misc_feature (996)..(996): n is a, c, g, or t
gagcacacaggaggacttctgggagaaagtgatagccaagcttaaacctggagaaaaagggaacgccaaacacaatatagagagcagtgtaccagacagtggggacactgtgctcaaagacctagaggccagagggtgaggcactgcagattgttgagtaggccgagatagagcatacaaaagcataacaaaagatggggctaggcagaccaggtaataaacctgcactttaaacctgcacttgatcctgagcacagtagagagccactgaaagattttaagcaagagagtgccatacagtgttggaatgattcactcggacagcaatgtggaagatagaccagaaagggcaagtccagaggccaacaataatcttagcctcagagttctttttttaatacccaagaatactatttcattttacttatatttttaaacttttctctataacgctctctctgctcccccacattgttgtctggatggtaaacctaggactggtctctgagtcctggtcacagcctggcaacagaatgtttgagcaaactgggaaggctgccccatggatccctggtttcttatcaccatcctcttaattctacgtttgccaaccagtctctaggaagccagcgtgctcttgcgcccctcccaccaggtttccagttgctaagcgtgtcatgtttgcatttgggtatcatctgcatgagtgaccattttaatctctctttccttgactacttgttctacactagagtctagggtgggggtgagtacagtggtaaagacagggatagcgggaaatttagtcttctgtttaggaagctggatggtagtgtggattttctaactccttgtggtaattaaattctggagcacagtttttagaccttttctgaaatctgttactgttgaagtcagcttcatatatttcactttttttttttttnttntnaagcnactggaaantgntgngaggggngcaagagcangctggcntcctagagactggttggcaaacccagaattaagaggatggtgataagaaaccagggatccatgggtcagcgttcccagtttgctcaaccattcaacccttgatt

SEQ ID NO: 422813 - DNA, 414 bp, Homo sapiens
tttgcatttgggtatcatctgcatgagtgaccattttaatctctctttccttgactacttgttctacactagagtctagggtgggggtgagtacagtggtaaagacagggatagcgggaaatttagtcttctgtttaggaagctggatggtagtgtggattttctaactccttgtggtaattaaattctggagcacagtttttagaccttttctgaaatctgttactgttgaagtcagcttcatatatttcactttttttttttttgagacagagtctcacactgttactcaggctggagtgcactggtacaatcttgactcactgcaacctccacagctcccaggttcaagcgattctcgtgcctcagcctcccaagtagctggtactacaggcgcgtgccaccatgcttggc

SEQ ID NO: 422814 - DNA, 4277 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422815 - DNA, 1059 bp, Homo sapiens
  misc_feature (836)..(836): n is a, c, g, or t
  misc_feature (839)..(839): n is a, c, g, or t
  misc_feature (842)..(842): n is a, c, g, or t
  misc_feature (844)..(844): n is a, c, g, or t
  misc_feature (860)..(860): n is a, c, g, or t
  misc_feature (866)..(866): n is a, c, g, or t
  misc_feature (872)..(872): n is a, c, g, or t
  misc_feature (877)..(878): n is a, c, g, or t
  misc_feature (884)..(884): n is a, c, g, or t
  misc_feature (891)..(891): n is a, c, g, or t
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggattttggcgagacntgntcncntagaattggggccagnctgtgncgtctngtgannactgtncactggngtggtgaactatccggatcaaaaaacagaggaacaaggagctctaagaacttcagatttagtagacgaaatcaagatatatgcccgagatgtgcctgcactaggaggataaactacaagagtgtggccacacgtggaaagagggcaagcaaacgcgagagaagagaca

SEQ ID NO: 422816 - DNA, 642 bp, Homo sapiens
aacattcgcgattttggataattttttcatttttcttctcagcctaaaaggctatcaagctgtgaggataagtcagaaaccactatgcaaccagattaaattttgtcaacagtgtgtatagtgaacgataaaaggtccgatggtaattgtaaaataaaaggatgaggaaaaggcagctctgtatccctgattaccttgctgcaaaaagtttattaacatctgtgtatacacaaggaggatggttattttatgcttattttctcttagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagaggtacttacaaatacaaacctacttgacgcagatattaatcataccatctgtcttgttctggcagataacacttacaaatgaatcaagatgatgaagatgtagtcaacagggctgtgataataatagtaaggcctccagtcttaccttagatagttagtatagtcactgttctaatgagcaatgagaaggaagaaagggacaatgtgagtcttta

SEQ ID NO: 422817 - DNA, 1112 bp, Homo sapiens
gtacaagcggtatctcctgcctcagctgggatcacaggcagcccagcagcgatgacctggcagattaaggtattaagtagtagagatggggtacatcatgctggccaggctggtctgaaactcctgattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422818 - DNA, 680 bp, Homo sapiens
  misc_feature (473)..(473): n is a, c, g, or t
  misc_feature (680)..(680): n is a, c, g, or t
ctaatgtgaacactgatttatttaaaaaatactacagaggacagatttggattcaaaaaaaaccacagagaatcatatacagaaacaaaatgcactggaccccgagaagcagagggggagccaccacaggcccccgagggggcagggcaggacgctatgcacacgccacttagaaaagagcgtctataaaagatgcataccaagagatacgtgtaaaatatagtggcacatcacgttaacaaaaggaagggaccagtacctcatggagacaggcagtcgggggacctgggtgggcgctttgctctgtcttcaaggccgctgtcggtgactagtgcctccctccggctgcgtcacagccgtcgggggcaaagaggtgatgtgctgtaagaaccgcataaaacgatccagaggaaaccatttctatcagacgtgccgaattcggcacgagatgcagaagcatttggaaatgaatncacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagtacctgctttcagaggctttaataatgn

SEQ ID NO: 422819 - DNA, 325 bp, Homo sapiens
caaaaatgctaataaacaagtatatctaactttgtagttgttaagtcacttttctttttttctgtctcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatgtaagtaacttgagaggtacagtaaggtac

SEQ ID NO: 422820 - DNA, 3681 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctccccttctatatccgcttccattgtcgtatcgggccatcttggggtcgacg

SEQ ID NO: 422821 - DNA, 3170 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagatgttgttgccccggtgtttctacctggccgatatattgggtgtgtttttcctcggcttgggttgccaggtgcttctaggaggggggttccctgggggttgcttccatc

SEQ ID NO: 422822 - DNA, 4523 bp, Homo sapiens
ggctgggggtgggggaagggacgagccgcccgcgggtccccggattgcgggttgcgtgcgcgcctcgccgcgatgcgcttgcgccgtccgggcagcctgtggccccctcccctctcctccgcccagcgtttcccgctgctgcctctagcaggcaaagcgcgcttcctcctctggcctgcgtacgccggggcaccgcggcggctgagggaagggggtgcttcgcctgtggtggttgccgccggggcgccactggcctagggctcttcattcattcaagccacgaataactggcgccgtcgtgcaggccttgtgggtagaggaaaaaaaattgaagaatgtaaagggagagcgcctttggctagtatagcgagatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422823 - DNA, 4414 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggtggaggagaatgagattgagtgctgactttaagcctggctgagaaacatactggcatcgatgtcattaatgaaagggtggatgttgttcccctgaaagccagtggcctttgacccctgaagccgctgtgcctgaaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422824 - DNA, 2838 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgccgctttccttcattgatgaaaggctct

SEQ ID NO: 422825 - DNA, 2873 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagaggtacttacaaatacaaacctacttgacgcagatattaatcataccatctgtcttgttctggcagataacacttacaaatgaatcaagatgatgaagatgtagtcaacagggctgtgataataatagtaaggcctccagtcttaccttagatagttagtatagtcactgttctaatgagcaatgagaaggaagaaagggacaatgtgagtcttta

SEQ ID NO: 422826 - DNA, 4223 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422827 - DNA, 2479 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggtaaatattaaacattagagtgatgggattggaagtgacgtagatactaaacaaatgttacaggctttcaaagagctacccaaaaaattgtaacccatctaaattgaggaagaaaaaaggagtcttctctttctgagcttagtagattgttgttcattaatcagttattgggtgatctttttaggacttctgtaattttcttgtcatt

SEQ ID NO: 422828 - DNA, 2356 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggtatgagtctttgaattctcacatatttgagagtgaaaatgaatgtttttgctagtgccttagccagtatgtgaaaacaaaattttgtattgtttctactttcgaataaaaatatgtataatggagagctgtttgaaaccagctcctgtttttagtccctgattgttctttattgttata

SEQ ID NO: 422829 - DNA, 3127 bp, Homo sapiens
ttaggtagaggccgggtgttaatcgagcgaggcacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422830 - DNA, 1600 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcaggtaagtggtaaaccaaccatgaaatacctagagagcagactatttctgattctttctttgattaactaatttttgtaattatttaagattgagagagcattgtgcccttgaaattaaattt

SEQ ID NO: 422831 - DNA, 2083 bp, Homo sapiens
aatctgagaatgcaggggtagaatctgataccgatggcttccaaaatgtggattcatttccaaatggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422832 - DNA, 1689 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggtttgcttgtttcattcttttccttctgtagtaagttaaggtggttttggatattcactgttgaatataatctatttttgtacgttgtctggttaattgtgtggattagaattgaattgttaaaagataacgttaatttgcacaagaataattattgatttgtgcagtttccatggttttcacatgagtgaattttagctgtgtaagaagttcagcgtaaatctttttgacatgctagacatttaagatgctcatttgaatctgaaaggcaaaagtcatgaccacaattgctggtttgtccctagttgatgtaaaagccagccaaaggtggtgattttttttttcaccttggtattgttagaggcagttactatttctttaatgggtcaggttagatacttaagctttgagtcccagaattagattgtattgcatctacatccacatttcacttaagccttgaaaactgccagctttcctaggagtcctagtgaaatttaagggcttatcgtaaggtcgaaaaggaacagccttggtctttgtatgtgggggtgtacttttttcctgttaaatgtataaaacaatataaagggaggtcattttaacagtatgtttctcagcctgcttgctgttcttcctgagagcattccagggtgtagtaattattactcccaggaaggctcatatggattagacttttctggggagcgatgtatttttattagaacggaggggaggttgtaatggaaacctttttgaatgattccgtttgctgtccgtacttatgaaataaattatccaaatacattaaaaatatttttctcgaaaatcaaagtgttctccattggatgcatctagcgaccctgaaataattaatattaatacaaaattttgtcactgatcaaaatgatattta

SEQ ID NO: 422833 - DNA, 1684 bp, Homo sapiens
  misc_feature (38)..(38): n is a, c, g, or t
tgtgtgggtatctagaggatccggctcccactggttgntgtgatgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422834 - DNA, 1663 bp, Homo sapiens
cttatgttctgacccacccttaggttctccaccctttctgacccacctagacaaggcccctgaaaagtcgaaggcagtggaatgcagctcgccatggtagggttagactcaggaggggacagaagagaacgaacaggattggtgtgaatgcaggaggcgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422835 - DNA, 1517 bp, Homo sapiens
ctaagatccggctccattgtttgttcaactcagctcggcacaccttccctatttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacacggaattc

SEQ ID NO: 422836 - DNA, 514 bp, Homo sapiens
agcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggtactgaagaatacagtttgcatttatgtgatttatgaggttcattttggggttaaaagaaaaatgttttctgtttggagatgttaatgtgttgcacattaggaaacgacagttctttattgtgacttgactgctattgtaaatcattttcaagtcagcattacttttaaaacaatctgacaggtaaattattctaattagagcctatatcttcctcagcttcctcagtaccagtagtggggatgggaccgacatt

SEQ ID NO: 422837 - DNA, 312 bp, Homo sapiens
gagcgcctttggctagtatagcgaggtaaggcgtctcgaaggagggaggctttgagctgataacctcggccaacgcgaaggaaaagcagagcctgcagaagcggaagggattagttatcgcttaagggcagaaactgggcgggagctgaaagcaggccatgtgactggagtgtggcgagaaggccttcaaaggagaatgggttttagggtggcaagagtggaaacaaaaaccgtgtaggacaatatttcactagcccgggtgtgcagtagtggtggcaggagagatggggagaaacgaatggataggggacg

SEQ ID NO: 422838 - DNA, 236 bp, Homo sapiens
tttccagagcctttcatcaatgaaggaaagcggctgggctatatccatcgaaattttgctggaaacagattttctgatcacgtagcccttttatcagtattccaagcctgggatgatgctaggtatgagtaagatttgggtgagctgtctgtagtttctcatttgtatttagttctctggtcttagagaatgatttctcatgccaatttattttagaatgggtggagaagaagcag

SEQ ID NO: 422839 - DNA, 622 bp, Homo sapiens
tactcagaaggctccatgagagttttgagtcaaatttaagtttgtgtttgaattttagtcctatcctgtgagaaatactaattagtggaaaagttcagtatattgatgtaagctctacatttttggaaattaaatttcttctgtattctatagtgtgtgactagtcaactagaataaataatgacattacaagtaattagagtcactagaagaaatctagaagacttacctcatgagtaactgagacaatccaaaaatatgtctccctgttttttacaggcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggtatgagtctttgaattctcacatatttgagagtgaaaatgaatgtttttgctagtgccttagccagtatgtgaaaacaaaattttgtattgtttctactttcgaataaaaatatgtataatggagagc

SEQ ID NO: 422840 - DNA, 4266 bp, Homo sapiens
  misc_feature (163)..(163): n is a, c, g, or t
gcggccgccgcccgcccaccgcgcgctcgcttgaccgcggcgcccgcccccggccgcccccgcccgtccccctgccgcgatgccctcccttcggggccccggcggcccgcgcccctgctaggctgcggcggcatggcccgcgcgcccggcgcgacctctgcgnattgcatcgttgtgtggcggcggggcatgcccagagcaccgggcacggccttcaatgggcgaggacacggacacgcggaaaattaaccacagcttcctgcgggaccacagctatgtgactgaagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggagaggaagcgttcaccgccgcaaatcataaaatggacatgactgtggagtcttacagttcagggttctttcattcacgtcccttcctgtctcggtctgcggtctttaccacatcaataggactttttatgcgtccgggttaatttttcactccagtgtgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccccctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacaagggtccgggagaactgagacgcaggatggaagacagagaagaccccccggagctcctcgctctgcttggtggcttcaggagtgcggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagaaccacgtagtttggcattttgattcagaaagtggggagcagagacccagccaaatccaaacttttttttggttttgtttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacgaggt

SEQ ID NO: 422841 - DNA, 4138 bp, Homo sapiens
  misc_feature (163)..(163): n is a, c, g, or t
gcggccgccgcccgcccaccgcgcgctcgcttgaccgcggcgcccgcccccggccgcccccgcccgtccccctgccgcgatgccctcccttcggggccccggcggcccgcgcccctgctaggctgcggcggcatggcccgcgcgcccggcgcgacctctgcgnattgcatcgttgtgtggcggcggggcatgcccagagcaccgggcacggccttcaatgggcgaggacacggacacgcggaaaattaaccacagcttcctgcgggaccacagctatgtgactgaagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggagaggaagcgttcaccgccgcaaatcataaaatggacatgactgtggagtcttacagttcagggttctttcattcacgtcccttcctgtctcggtctgcggtctttaccacatcaataggactttttatgcgtccgggttaatttttcactccagtgtgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccccctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggtctgcttggtggcttcaggagtgcggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagaaccacgtagtttggcattttgattcagaaagtggggagcagagacccagccaaatccaaacttttttttggttttgtttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacgaggt

SEQ ID NO: 422842 - DNA, 4073 bp, Homo sapiens
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggagaggaagcgttcaccgccgcaaatcataaaatggacatgactgtggagtcttacagttcagggttctttcattcacgtcccttcctgtctcggtctgcggtctttaccacatcaataggactttttatgcgtccgggttaatttttcactccagtgtgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccccctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacaagggtccgggagaactgagacgcaggatggaagacagagaagaccccccggagctcctcgctctgcttggtggcttcaggagtgcggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagaaccacgtagtttggcattttgattcagaaagtggggagcagagacccagccaaatccaaacttttttttggttttgtttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacgaggt

SEQ ID NO: 422843 - DNA, 4342 bp, Homo sapiens
  misc_feature (163)..(163): n is a, c, g, or t
gcggccgccgcccgcccaccgcgcgctcgcttgaccgcggcgcccgcccccggccgcccccgcccgtccccctgccgcgatgccctcccttcggggccccggcggcccgcgcccctgctaggctgcggcggcatggcccgcgcgcccggcgcgacctctgcgnattgcatcgttgtgtggcggcggggcatgcccagagcaccgggcacggccttcaatgggcgaggacacggacacgcggaaaattaaccacagcttcctgcgggaccacagctatgtgactgaaggtaacgtacgtgttgtctgagacccctccggccggccgcggcgtggggatgccgtcgcaccgaatgccctccgaagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggagaggaagcgttcaccgccgcaaatcataaaatggacatgactgtggagtcttacagttcagggttctttcattcacgtcccttcctgtctcggtctgcggtctttaccacatcaataggactttttatgcgtccgggttaatttttcactccagtgtgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccccctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacaagggtccgggagaactgagacgcaggatggaagacagagaagaccccccggagctcctcgctctgcttggtggcttcaggagtgcggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagaaccacgtagtttggcattttgattcagaaagtggggagcagagacccagccaaatccaaacttttttttggttttgtttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacgaggt

SEQ ID NO: 422844 - DNA, 4212 bp, Homo sapiens
  misc_feature (34)..(34): n is a, c, g, or t
  misc_feature (83)..(83): n is a, c, g, or t
  misc_feature (198)..(198): n is a, c, g, or t
gcggtggtgcagagctgcggcaaagggccctcgncgttggggttcacttctcatcacccagaagcagggagaagggcctgcgntgcacttgggctgccacaccggcctccagacagcacacagcagaagtaaaatagaaagaagaccttttttgaaatgacctgtgttagtcacctctctcaggatgcgtgaggcggncacgttgaggccacctcagctgatggaagtttccgctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggagaggaagcgttcaccgccgcaaatcataaaatggacatgactgtggagtcttacagttcagggttctttcattcacgtcccttcctgtctcggtctgcggtctttaccacatcaataggactttttatgcgtccgggttaatttttcactccagtgtgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccccctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacaagggtccgggagaactgagacgcaggatggaagacagagaagaccccccggagctcctcgctctgcttggtggcttcaggagtgcggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagaaccacgtagtttggcattttgattcagaaagtggggagcagagacccagccaaatccaaacttttttttggttttgtttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacgaggt

SEQ ID NO: 422845 - DNA, 3666 bp, Homo sapiens
gcccatcgaggccaaggaattgggcaagaggcttaaggacctgtccacggtgcagtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggagaggaagcgttcaccgccgcaaatcataaaatggacatgactgtggagtcttacagttcagggttctttcattcacgtcccttcctgtctcggtctgcggtctttaccacatcaataggactttttatgcgtccgggttaatttttcactccagtgtgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccccctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacaagggtccgggagaactgagacgcaggatggaagacagagaagaccccccggagctcctcgctctgcttggtggcttcaggagtgcggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagaaccacgtagtttggcattttgattcagaaagtggggagcagagacccagccaaatccaaacttttttttggttttgtttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacgaggt

SEQ ID NO: 422846 - DNA, 1161 bp, Homo sapiens
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgctaggcgaccatgctgcatcaacacgccggcaaggagagcc

SEQ ID NO: 422847 - DNA, 1498 bp, Homo sapiens
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgcttcaagcgtacatgcggtgagtatggggacagtggacatctgggcccctgggggaagggaaggaccccaaatatcaagggcccccaaaggaaggggtgggatgctgagggtcctaaataaggagggggtagggacttggacttctgggtactaggggatgaagacagaggtagaggaggcgctggggcaccccgactcctgggtctttctggagaggggctgggggtctagacacctgggtctgaggggagaggggctggggtctggactcctgggttcccaagaaaggagcagccaggacccggggcacactgagtctacactgcaggaaatgaccggttcacagatgttcacatggggatcactctagagtctac

SEQ ID NO: 422848 - DNA, 1245 bp, Homo sapiens
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatcaatgcggttagatccctggccctgctccgtgggttaaggatctggagttgccttgagctatggtataggtggcggatgcagatcggatctggcgtggcaggaaattaagatcagagcgatgaagggccggaggcgaggaatgcaagcagcctctagaag

SEQ ID NO: 422849 - DNA, 1384 bp, Homo sapiens
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtgggcaccacagcaggagacccccaatcccgggtcttttttccctatgctgagatccccatggagggggccttcctagccaggcgtggctttcatatgcccagtatgtaggtgaagacacggaggctgaagaaatccagcaactcatccccacacgtagcttggcagagggcaggagtgctcagtcttgcctcacagggagctttggatgtccctgagcaaggcctgcagtccagggcccaggggcctcaattccagggaggaaagagatgtgggaacagagatgagcgtcaggctgggccccagtggagcatgtagacgatggcttccctccccactccctgggagcctgcatcggagctgtaccattaaagagggttaagcgttgccctcccagggt

SEQ ID NO: 422850 - DNA, 443 bp, Homo sapiens
ctcatgttagagcgacattcaaatggaaggtttggaaaggaatgcctctgtcttgtgaagtaggacatggcagacttggcgacgacaagggtccgggagaactgagacgcaggatggaagacagagaagaccccccggagctcctcgctctgcttggtggcttcaggagtgcggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcag

SEQ ID NO: 422851 - DNA, 429 bp, Homo sapiens
atcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaacca

SEQ ID NO: 422852 - DNA, 2035 bp, Homo sapiens
aaagcaggggaaggtatttccccaaagcctgcttttcctctctctgttctccttgggaaaataatgattccaattaaagaggacaccagtaatactgacccacaaggtaactgacctaaacactataaaactgtatatatttccaggctgcatcttcagcctgatatgtactttgtagttgcaacagcgccctaggtgccctatggcccaccaagtttgaggagggtggtgctttccggattgagcctgggcaggctctgtggagctcaccaagagagctgggggcaggcccaccctcctctttgcgccctttctctccctcttggtgcccctgccctccgccccaccacagcactctcaggaaaggatcagaatgcaggatctttgtgtatttcttccagggatatttgcatttaagccttaattctcattgcaagcgaaaggcttggtccccctgggaaggcgggtttcggcaccggtgggcaggtggttcagtgtcaaggaggctgctgctggtcccatggccacctgctggctttgaggtagtgagggagggtcaatccttagggggagtcaacatgtgaatgctaaagaacactgctgcacagcccgtggggtggcgccagggtttctcaacctctactgacattttgcgataggttctgtatgccgtaggatgtttagcaacatccctggtctctacccatcatctgccagtagcaacccccaagttaggtgtgacaaccaaaagtatctgtcgacattgctaggtatctcctgggggcctccacaagttgagaaccaccaggttatgccagtggtttgtcatgcatggatctgtagagggactgtggcgctccggctgctttgttccatagaaagcctgtatgtgacaaagctgccagcctttatcttgatacccaagcccaggattttccatgtgtcttcagggggcaggtaggggaaaatggggtgagccacctccaacagatgccaacctgttgggtcttgaattttcactcactgaagatgccccctgcccgctccccacttcctagaaagcaaaactcgttacctttgttttccttggccacattttactggaagcaacaggaacttcttaatgggtttgtggccctcaattggtttttaaaaaaatctaacagatcttattggcaaatattcaagatggtgatgctggaaaatttcaggacttttcttttgcaagtgagccggtagctgtgtttgttgaccacattctttggcagttcctcccagaagatcaaaggatcctgcagctttaacctaatatctaggctgtaaaaatatgagggcaggtttcgggcaggatgtattgatcagacaccaagttcagccctcggttacttccctcttttaacctggctttaatagtgattcatggtatgagtgggggccaatctcttatcctttctgtgcctcagtatccccacctgaaatgagactagtcatactaacctacctcctctgatgtattgtgaggattatacaataacatttttaaagaaaaaaagtgcagtctttcatctctggcatctaagctaatgattcccattcagtgactcaaacctgtggggggcgttccagtgttctctgaccagtgtcttccatccaagcctccttgtgaccagggcaaggagctgcctggcctccagtgggtaaaatagacctttaagacaggtttcctatgaccatagaaagtaacaccccatatgtttccattcccggcgaggcctgtttgaatggcgctctgtgtgagtgctatgaacaggctacctgtcagcagtctcactgcgaggcctcaaggctctgtgagcagaagcccctttaaaccaaggaaggacactaacccaggcctctgccttctttgttacctaagttctggtatctaaggggtctctcatctcacagcttgcctcctttgtttcgaggggtctctgcagtgtgaatgggtttgaaatccagtgtggatagcacgaagagatgcaactgagcc

SEQ ID NO: 422853 - DNA, 2260 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422854 - DNA, 2165 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422855 - DNA, 2113 bp, Homo sapiens
agtagaagagcgatgttgagagctaaggtcgggccggtgatgtagagggtgatggtagatgtggcggcttaagggaccccccaaggtcccttaagcctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422856 - DNA, 2647 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtgagtaatgagaggggagcagactgtggaatgaatgatgtggtggtggatcccaggaaatgaaggaaaaagaacaggatgagggtagcactcagggggataggaggtaagtttagggtttgggacagttatggggaagggggtttctggaggccagaagtcctgtgttccccctcaggtggaacctgaaaatgctgcagtgccggagctgcctgcagtggttccatgaggcctgcacccagtgtctgagcaagcccctcctctatggggacaggtgagaccaaggcagactctctaggagccaaggatgccctctttcttcgtgttccaccctcagttctcccacgcccttctccactccagtctcttcccaacctctgcagcgttacctcacctgtttgccccgtccttgcttgtgagtcttccaggggatggcacagttttcctgtgtaagtgtgtttgctccctcttgcccatgtccaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422857 - DNA, 1801 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtgagtaatgagaggggagcagactgtggaatgaatgatgtggtggtggatcccaggaaatgaaggaaaaagaacaggatgagggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422858 - DNA, 915 bp, Homo sapiens
tcctcctccccactcacccaggtactgcacagagccatcaagccgtactctccgagcaaggacccggacagggtcccctcgggacaggtaaccaaccccacctcggactgcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422859 - DNA, 2157 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422860 - DNA, 314 bp, Homo sapiens
gtaaagactattcctgtcccaataccaagcacacacaggtatgcaataagtggtctactattatcactgcagcttatcaccaggactgccatgttcccagggctccagcccctggagagggagagggcacatcctgggtatgccgccagtgtgtctttgcgatcgccaccaaggtaaaggcacttccctgttacccttcctgtgggagcctcccatccacagcctctcccaagccttttcctctccccacccctctgaagccacccacctgtcctgtctctgcagaggggaggtgccctgaagaagggccccta

SEQ ID NO: 422861 - DNA, 249 bp, Homo sapiens
gactcccctggctcttaaaatgcctctgtggtcttgaaaactttgtttttccagggtggatgtggcccatcttgtcctgtatcacctcagtgtttgctgtaagaagaaatactttgattttgatcgtgagatcctccccttcacttctgagaattgggacagtttgctcctgggggaggtaaggggtagtgcagttttgggggttgggatgggacagggagatgtagcggaaaggggaagagaagaaat

SEQ ID NO: 422862 - DNA, 358 bp, Homo sapiens
gaggaatggcgtaaggaggaaccgttttttacagcactgaccctatatcatttctcttcttgccccagtttcatttcagggagagagattaagaagaggaaatgtttgtttggtctccatgctcggatgcctccccctgtggagccccctactggagatggagcactcaccaggtcactggtccaggggggatgggggaaattctcagggtgttagtcctggggggtatatgtatagagatggggaggtcttgggggtgtccgggagggggctggggggataaggaggcctcttacagcttcccttcagggcagggccctgggggaggggtctcacgtcccctggggaagcgccggag

SEQ ID NO: 422863 - DNA, 495 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422864 - DNA, 2385 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccaggtcactggtccaggggggatgggggaaattctcagggtgttagtcctggggggtatatgtatagagatggggaggtcttgggggtgtccgggagggggctggggggataaggaggcctcttacagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422865 - DNA, 2780 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtgagtaatgagaggggagcagactgtggaatgaatgatgtggtggtggatcccaggaaatgaaggaaaaagaacaggatgagggtagcactcagggggataggaggtaagtttagggtttgggacagttatggggaagggggtttctggaggccagaagtcctgtgttccccctcaggtggaacctgaaaatgctgcagtgccggagctgcctgcagtggttccatgaggcctgcacccagtgtctgagcaagcccctcctctatggggacaggtgagaccaaggcagactctctaggagccaaggatgccctctttcttcgtgttccaccctcagttctcccacgcccttctccactccagtctcttcccaacctctgcagcgttacctcacctgtttgccccgtccttgcttgtgagtcttccaggggatggcacagttttcctgtgtaagtgtgtttgctccctcttgcccatgtccaggttctatgaatttgaatgctgtgtgtgtcgcgggggccctgagaaagtccggagactacagcttcgctggtgagctggattgggcatgacctcagtgtaactccacaccacagtatttcactctatatgccccaacctcccacctcaggactcccctggctcttaaaatgcctctgtggtcttgaaaactttgtttttccagggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422866 - DNA, 2796 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaaaaaaaacaaaacaaaaaaaaaaacaaaacaaaaaaaaaaacacaaacaaaaaaaagggggggggccgccaaaaaattccccccggggggggccacaatatagacgcgcaaccccgcgacttttgtgcaacagagggggccccaaaaagggggggcgcctaataaagagacacagacgcggggcgcggtaacaacagcggcgagacgggggaaaacggggacgagggaaacactctgggagaaaggcgagccacacaacactacggggggggaggaggaagacaacatattgtggtggggaagacagtagcttcacttagcagagggagtagaattattaaagaggccctccaaaaggagtgaaataactaaagacgaactttgtagagcgggtgtgaaatctaggtggtgggtgacacaaaacgaagggaaggaagataattgtcgagtatcgggtggtgagagagtaagtttgaggggcaaacagctgagagaatgatgtagttgtagcgcaaggataattttttattcccgggg

SEQ ID NO: 422867 - DNA, 662 bp, Homo sapiens
gattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaa

SEQ ID NO: 422868 - DNA, 2340 bp, Homo sapiens
aaggtctgaaaaataaatcatatttagaacgccattggtagcttaaaaatggttttaaacctgaatttgaagaaaatgttgagaccacgatgtaaccaaaaagaaataattgggttatttctattccaaatgtctttggtgactgtgtgattttaaaccaaattggtttatctatctaggcatttaaacaagttctcagtgttctaaagaagtacatgtactgaccctgacaatcatgttcttttaagcctttagattattgactatccaggttgttccacagagtctctttttttcccccttctttcttgaagatctgtgagtaatggactaattgctattaaatttgggagctttacatatgccacaacagaaaaagtcagaagaaggtaagtcttgaatcttgtttggatgaaatgtagatacatgtgatatgtgtatatgtttaggaataggatcagactcagttatggtggtaatataggtaaaagggctttgccacttcccacatcaagggcaggattctttgtgtatttatacatagagaatgatttgacttctgattgaatagaaccttactgccctgcagtttatgtcatacggtttcctataattaatactcctgagctccctgttgacaaagaaagtaatgtggttcccatgggcagatggcctgcagggctgaagttcttgttacgaccaaaaaaaattatgaggtgatgccattcttagtgatgggagattttcttaggattcaaaatggtaacagtacctaagccatccctgaggcttcgcaagggaaagaagtgactaatcataggctgatctttttctcacttttttcctcacataaaataagtttttttatgataaagtctttggagttgctgtgcctatttttcatgtgtagtatcttatttttatttctcagtctagtcaactctgctgaatgtgtatataaggtgtcattcatagaatttccacaggcttaaggcctaaccattgatggccaggggctttctagaactgaaacaacttcacagatttttgggggtcatgattacccatttttaagatttggttatatatgtgaataatcagtacaaaaagtaactgattttaatacaaaccaatgatatattttaaatgttattgtacagaatgtcacttaacttttaaatttttttctgcttgctgccagtataacatgcatacaatattttctcagtagtcacgatcatctttgatataacaaaacttattttaattctagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtggtaagtgtttagagatcgttcagcaactaagaaattacaagaagtaacgttgcttctttggaaccttcatcaaatacatgatatataaggtccttttgtgcaaatatttttactgtgatttatagcttgtattgattatgatcatgtggtggccttagctatttagttcttgttctgataaagcttactaagtagttaataataatactagattttaatctcacgaaattgccactgttgttatgtggagatctttttatacaaaatgaaggctgaatttattgattttgttgtaaattgatgggaatataactttcctataaaaccattctttgattcagacttctgatttctaattctttatatatgataagccattaatttaaaaatgcttttatggccttttcttttttagttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422869 - DNA, 2695 bp, Homo sapiens
cccgacgccggaagtgcctggagcgcgcgacagcggcggggcggggcggcctggaggctgtggcgcgcggccggcagagggaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataagatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422870 - DNA, 2599 bp, Homo sapiens
caggagaatcgcttgaatccgggaggcagagtttgcaatgagctgagactgcaccactgcactccaacctgggcaacagaatgagactctgtctttaaaaaaagaaaaaaaaaaatgttcctgtcacctttatcactcaggaaattccaagggttttggaagctctgttctaggaactagaaacaaagatcaatgtttttctgtgataacatagcatctgtcaccttgagaacttaaaatgttaatgtgattgtagttcattttatccagcatggctttatctaagggagggcctacaaagcacagtggaagagggtgggcattagagtcagacttgggtttgattgacagaactagatacttagttattttcacactgggcaattgcctaaacctgttaagcttcattttttttttcatctgtaaattggagaatatggtgtttacttcatatggctattgtaagcaataaaaaaaaaaggtattttaaacacctagcatagcaggtgttagtgctaaattatatattactttctcctgataaagtaaccttttaaaaagtaaagagcttatttatatagagctagtttccagtctcttgttttagagacttaaaaaacagtactggactgctgttgttgtttcactgtggcaaagaatagaagaatgaattttatttcatcatatatttgatggttcccaaatcattccttgcttcttatagccagcagaaacctacagttggattttggtgagtctaagtttgtagtaagtgagattgtttttagtgagctgtcagcgggggttgatgaaaggcagaagaccatggtcgtttttaatgaggttgtgtgaaaatccaatgaagtggtcagtgaaaattctacctcgagataaactgtgcagactggctctaacagtagattattttcttctaattataagtttgctatagcttcttttatttttgtttctgtttttgtttgaaaccagaaagtcctttgctgtttccttattatcctcgaaaatcattgcattttgtgaaaaggcggatggagaatattattgatcagtgtttgcaaaagccagcagtaagtttgaaagaaatgcatgtctttgtgtaggagcaatagtgtctacagtatgtggctcacttatgtaaatgatcttaatttttagaatgaactatgaaaatgttgatagtcaactgtttttgattaacaaaagtaacaatttcatatggttcaacctaatactccaacttaagtttcttacacacgtgtgtgtgtgtgtgtgtgtgtataaagattactgaaggtgttggcatcttgagtattttatttgttcccagaagaaattcattgtaaacagtcttagttacagagctgatgtgtctctgcttactactgaaggatgtgaatgaatggttgttatgagaccagagggaggtggtcttaaacctgccatgtgcttagcaccaaggtccttttcagctcagaattttctctttttccttactgttacaattgtcattaacgtttcttatgtacaaggtttggtgatgtaggcgatttttttaccacattcgaacagtgatggtcagtcactttctgtagagtatctgtgtgcatattaacgctctaattatattttaaaatcttattttatataggatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422871 - DNA, 5257 bp, Homo sapiens
  misc_feature (3873)..(3873): n is a, c, g, or t
  misc_feature (4333)..(4333): n is a, c, g, or t
cccgacgccggaagtgcctggagcgcgcgacagcggcggggcggggcggcctggaggctgtggcgcgcggccggcagagggaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataagatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagtaagtttgaaagaaatgcatgtctttgtgtaggagcaatagtgtctacagtatgtggctcacttatgtaaatgatcttaatttttagaatgaactatgaaaatgttgatagtcaactgtttttgattaacaaaagtaacaatttcatatggttcaacctaatactccaacttaagtttcttacacacgtgtgtgtgtgtgtgtgtgtgtataaagattactgaaggtgttggcatcttgagtattttatttgttcccagaagaaattcattgtaaacagtcttagttacagagctgatgtgtctctgcttactactgaaggatgtgaatgaatggttgttatgagaccagagggaggtggtcttaaacctgccatgtgcttagcaccaaggtccttttcagctcagaattttctctttttccttactgttacaattgtcattaacgtttcttatgtacaaggtttggtgatgtaggcgatttttttaccacattcgaacagtgatggtcagtcactttctgtagagtatctgtgtgcatattaacgctctaattatattttaaaatcttattttatataggatgtaattggaaaatcgatgaatcaagcaatctgtattccattgtatagagataccagaaggtaattctgtttacctattggatggtgtaattccgcagccaatttaaatttttctcatttctttttcccttttattttagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaaggtaagtcttgaatcttgtttggatgaaatgtagatacatgtgatatgtgtatatgtttaggaataggatcagactcagttatggtggtaatataggtaaaagggctttgccacttcccacatcaagggcaggattctttgtgtatttatacatagagaatgatttgacttctgattgaatagaaccttactgccctgcagtttatgtcatacggtttcctataattaatactcctgagctccctgttgacaaagaaagtaatgtggttcccatgggcagatggcctgcagggctgaagttcttgttacgaccaaaaaaaattatgaggtgatgccattcttagtgatgggagattttcttaggattcaaaatggtaacagtacctaagccatccctgaggcttcgcaagggaaagaagtgactaatcataggctgatctttttctcacttttttcctcacataaaataagtttttttatgataaagtctttggagttgctgtgcctatttttcatgtgtagtatcttatttttatttctcagtctagtcaactctgctgaatgtgtatataaggtgtcattcatagaatttccacaggcttaaggcctaaccattgatggccaggggctttctagaactgaaacaacttcacagatttttgggggtcatgattacccatttttaagatttggttatatatgtgaataatcagtacaaaaagtaactgattttaatacaaaccaatgatatattttaaatgttattgtacagaatgtcacttaacttttaaatttttttctgcttgctgccagtataacatgcatacaatattttctcagtagtcacgatcatctttgatataacaaaacttattttaattctagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggtaactagtaacattgtctttctgatattacagttaaatgtttttttaatgcacattataaattccaaccttttaggtacgctagataatggttatttcgttactagaganaaccacagaggtagctgagcagaaatgctccaatttttcattcaaaatatgctggccttaatagctttttttgtccctttgctttactagtaaatcaggaagtatttgctggaatcaaggtggggaattatttggagtggataatgggacttcttttagttacatttttaaggatagcattaaccctagttggttggaattagttatttttgatttgccttcagtattttccttccagaattaagacctcagtacccatgtaggaagtatactgtcaattccaagagatggctttaattgactgagacttaagtaagcagatctctaatttaaaaatgtatccatttgctttctttgaaagggagtcagaaaccttgctaagatgatattctgcctgtttggaattacagtatttcttttcttttttttttttgaaacagggcctctctttgtcacccangttggagtgcagtgacgcaatcatagctcactgcagcctccaactcatgggctcaagtgaccctcctgcctcagcctctcatagctgggactacaggcatgtgccaccttgcctgactaattttatttttttacagagatagagtcttactatgttgcccaggctggccttgaactcctggactcaagcaatcctcccaccttggcctcgcaaagtgctgagattccaggcatgagccactgtgcctagccagaatatagaatatggaatttttatagaatattatatcacagctttttttctaacacaacagttgctaaaattatattggaaatagaagtatgagtagaagtcaaaaccataattgaccctaataccacctgtagtaaaactagggaggataagatccccttttcattcctgagttggtttttttccctctttaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422872 - DNA, 1948 bp, Homo sapiens
tttttgtgagtttctaacacatgtacccctctccatccacagccattttaatggtattttagaaggtagaggctgtagatgtgtgtgctcagaagacaaaaaaaacacgaagagaaatggcattgcttttcctgtatttcgaagtattttttggttcaccgtatttgcagagagcagatataaaatactacgctttctatgatcacttctcagtatgaatgaaaggtagtttaacttattgttctttcaggtaagtagaattattacaggttccagatggagaaactgaggcattgagcattttgatgttggtctggtggcctggggtagggttgaacatattgactgcacaaaggaactttttttctttctcttatcattgctgcaagagggttttgattatattgcttagtaacataagagatgtttcagtcttttattccaagcgttttactttgtactgaaaggttaatgatactgacctacctcttcattggtattatgaaacttaatgcttggaaagggctttgagatttgggaatgaaaagcacaggtttttgcctagaataattatcgtatacatgtgagcttaaagagattgtttaaaaagtgataacccatgtctgtattcagaaacagttttatcaaaatgaagatgacttccatttataacacttaattttgggggtacatttgtgtaaagccaagggaaattcaacttttgagatctcaattgttaggataaaaaatcagcttccaaaaataatggtccattgatatcagaggtaatgacagcacaaatttgtaataatggttttctgttgaatacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422873 - DNA, 1450 bp, Homo sapiens
ctgcgcaattaaggttttgtcaataaagggtgtaacgcaactaagtcatagtccgcctagaagcatatgcggtggacgatggaggggccgatctcgtcatactcctgcttgctgatccacatctgctggaaggtggacagcgaggccaggatggagccgccgatccacacggagtacttgcgctcaggaggagcaatgatcttgcggcgttggatgcagtcgactgcatccaacgccgcgactgcaccaacgccgtgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422874 - DNA, 1925 bp, Homo sapiens
aaggtctgaaaaataaatcatatttagaacgccattggtagcttaaaaatggttttaaacctgaatttgaagaaaatgttgagaccacgatgtaaccaaaaagaaataattgggttatttctattccaaatgtctttggtgactgtgtgattttaaaccaaattggtttatctatctaggcatttaaacaagttctcagtgttctaaagaagtacatgtactgaccctgacaatcatgttcttttaagcctttagattattgactatccaggttgttccacagagtctctttttttcccccttctttcttgaagatctgtgagtaatggactaattgctattaaatttgggagctttacatatgccacaacagaaaaagtcagaagaaggtaagtcttgaatcttgtttggatgaaatgtagatacatgtgatatgtgtatatgtttaggaataggatcagactcagttatggtggtaatataggtaaaagggctttgccacttcccacatcaagggcaggattctttgtgtatttatacatagagaatgatttgacttctgattgaatagaaccttactgccctgcagtttatgtcatacggtttcctataattaatactcctgagctccctgttgacaaagaaagtaatgtggttcccatgggcagatggcctgcagggctgaagttcttgttacgaccaaaaaaaattatgaggtgatgccattcttagtgatgggagattttcttaggattcaaaatggtaacagtacctaagccatccctgaggcttcgcaagggaaagaagtgactaatcataggctgatctttttctcacttttttcctcacataaaataagtttttttatgataaagtctttggagttgctgtgcctatttttcatgtgtagtatcttatttttatttctcagtctagtcaactctgctgaatgtgtatataaggtgtcattcatagaatttccacaggcttaaggcctaaccattgatggccaggggctttctagaactgaaacaacttcacagatttttgggggtcatgattacccatttttaagatttggttatatatgtgaataatcagtacaaaaagtaactgattttaatacaaaccaatgatatattttaaatgttattgtacagaatgtcacttaacttttaaatttttttctgcttgctgccagtataacatgcatacaatattttctcagtagtcacgatcatctttgatataacaaaacttattttaattctagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422875 - DNA, 1881 bp, Homo sapiens
cccgacgccggaagtgcctggagcgcgcgacagcggcggggcggggcggcctggaggctgtggcgcgcggccggcagagggaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcagtaagtattgggagtacctggaatcactgacctaagaatatgtcacttttgacctaaataagaacctagtaagctgttatgattctcttaaaatcagtttttaaatttttatcacaattatgcctttatatggttccgaaaagccagcagcacagagaatttataaagtaaagctgtattttcctgtcctggtcatccttacctcaggtcttctcgccagagggaatcattttaactctttaactacttctatttttagttcttctatgggttacctccatatttctaaattgtatgactatgccacatttcttttgtcaatttttagaagttattctctttgttttgtttttcttagactgttaggcttgcttgttttcttgcattgtctgttttttctgcatccttccgtcctttcccttctgaagggtggtgtagtacctctggagtcccctgttccagatgccttccttagcccacgtccccgatcggtgtcaacgacggccgtggcccagctgcatgccc

SEQ ID NO: 422876 - DNA, 533 bp, Homo sapiens
tatataaatttgtcactaacatgtatgtgtgaagcatgggaagaaatactaatgcagatggattctcgtctcaccaagtttgtgcaggtaaagcagctgaagtttcccatggagagagttaaagaatgcatgatgtatgtctttaccttgaggtacatgagaaaaatcagtttgattcataaaaggctaagatcataatttctttcaaatggcttcgtctgacttcaaactgcttcctcagatttgccaaaagggctcttttcccattgatacaacttaagtggggacaggattgtgaagtggagctggtggggctttggcaataagggcaggtgttagaacagctgattggctatcttctagtcactgatgttcagatgatcactttatggatttgatggaagtctaaggcaaggaaagggagtcatgctcctataattttgaataaatatgccttataatttaagaatacatatatcacaatttttttttcactttttttccaggaaaagaacacaaccacatcagtgcaa

SEQ ID NO: 422877 - DNA, 242 bp, Homo sapiens
tctcggaaccccaggcgttcatattttcacagtcgcataatctatatttctttgaaagaactttgccagttttcccatggcttttagtagatagtaaaaatgtcacatttataattatgtaccatttcttttattgagcagctttcttttatcttgatttttctttttgttccttttgttgatagatgactcagaaagatatcacatttgttgctgaatttcttactgaacatttcaatgag

SEQ ID NO: 422878 - DNA, 451 bp, Homo sapiens
  misc_feature (37)..(37): n is a, c, g, or t
tttaccggattcttcgcgggtactggaatagaacagnggatccttcgggctgtaggaattcggctcgagcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacgtaatgataatattacaaaaaaaatatgtttttattttcacaaagagtattctgtaaagcccattttcagaaaggatttattgttcttagtatacataagaattataaatatcagtttgggaacttttta

SEQ ID NO: 422879 - DNA, 3356 bp, Homo sapiens
cccgacgccggaagtgcctggagcgcgcgacagcggcggggcggggcggcctggaggctgtggcgcgcggccggcagagggaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataagatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagtaagtttgaaagaaatgcatgtctttgtgtaggagcaatagtgtctacagtatgtggctcacttatgtaaatgatcttaatttttagaatgaactatgaaaatgttgatagtcaactgtttttgattaacaaaagtaacaatttcatatggttcaacctaatactccaacttaagtttcttacacacgtgtgtgtgtgtgtgtgtgtgtataaagattactgaaggtgttggcatcttgagtattttatttgttcccagaagaaattcattgtaaacagtcttagttacagagctgatgtgtctctgcttactactgaaggatgtgaatgaatggttgttatgagaccagagggaggtggtcttaaacctgccatgtgcttagcaccaaggtccttttcagctcagaattttctctttttccttactgttacaattgtcattaacgtttcttatgtacaaggtttggtgatgtaggcgatttttttaccacattcgaacagtgatggtcagtcactttctgtagagtatctgtgtgcatattaacgctctaattatattttaaaatcttattttatataggatgtaattggaaaatcgatgaatcaagcaatctgtattccattgtatagagataccagaaggtaattctgtttacctattggatggtgtaattccgcagccaatttaaatttttctcatttctttttcccttttattttagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422880 - DNA, 1403 bp, Homo sapiens
tatctgctactgaaacaattgtttcgggggagagaatatttttagaatccaggcatggcccaaacaattctctttgaaaagaaagcaaactggaatcctgggaaagccgttaattctcaacactacttataaacatgacaaacaataaaataaattctataacaacttgtaagagcttatgttttcacatctaaattttcaatggtaaggttccttacaatctcaagtgttaaacaaaaggtatcaagcacacttaggttacaaggagaagcaaaaagattggtttgagcaacctggatcactttcaagaagcaggaactggtctatacaatggaatacagattgcttgattcatcgattttccaattacatctgctggcttttgcaaacactgatgtaattggaaaatcgatgaatcaagcaatctgtattccattgtatagagataccagaaggtaattctgtttacctattggatggtgtaattccgcagccaatttaaatttttctcatttctttttcccttttattttagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaa

SEQ ID NO: 422881 - DNA, 361 bp, Homo sapiens
tttgaattgatagaaattaatttaaagatttcctactggacattttaaaatgcgtattgacccacaaacctgtaaatggttgaaagtactatttgagagaaatcattagctcaggtgtaggaatatagaagaactacaagattatatttgacaaagcaagatctgaaaaaatgtattttcattgacagtaagtaaaaataatgtggactcttacaaagaaatttgaaatttatcagagaaagctttgcagaaaagtaaattttcactattcacttcatctttattttcaaacacattcatctctattcacagattaggtgttctacactttaaaattcagctttataacgttatagttttt

SEQ ID NO: 422882 - DNA, 341 bp, Homo sapiens
ctgcactttgccttggtgagggccagatggctttctggcctctggaacatcagtcctgattctccaggggacagagggcagcagcactcagcgacccagtgggacagctgcgtgcctgcagagggcgtggttttgattccaggcaagggcatgcatggtctaaccctttacaagaggcctcgatgttggtggccgacttactttttcttttagttttatacacgggacaaggtctacttttccatttcttttccatttgttcctctcattttttttttttattttgtcttgtttttagacgaagtctcattcttgtcgcccaggctggagtgcagtggcac

SEQ ID NO: 422883 - DNA, 475 bp, Homo sapiens
tggtgtaatgtcttcaaatattaccaaaccttcctctttaattgaaaggtctttccccattttcagtttatacattagcactgtgggaaaaactgcttatgaaccaacactacttccacgttatattgacattatttctctatttaccaagtgtgtatgggccaattcacattaaagaaaccaacactgcaacagaacagactataatcaactctgggttatgtgctttcaagatcattatgtgctttcaagatcatttgggttatgaagcctcaaatgcctctgagtgttaacttttaggcacatagtattgactgtacccttccacctacatttgtactgctatttagtcaaatcctttacagtagtccacagaattaaaaaccatctctagtccagaggacatctaaaagagacctaaactttatatcaagagcacaatattgggccaggtgtggtggctcatgcctgtaat

SEQ ID NO: 422884 - DNA, 3262 bp, Homo sapiens
  misc_feature (972)..(972): n is a, c, g, or t
cctgtgcttctcgaccaactttgaataaaaagaaaaaatccaaagtaaaaccaaagaaaatccagcaaggagaggaggaggaaaaggaattcagtggtgaaatagaggcagtcccagtcactggcacaggcagagtgaacctgcatgaagggaacacttggtgtcccttcttcctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaagtgccttgcaaatttagtatcaaatgcaccttatgatcgtctaaaactcagcctgctgaccaaagtctggaaccagataaagccttatattcgccacaaagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaancccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttacaggtattgactcttctggcaaggggctacttttcaatgactcaagcctacttgatggagcttggagaggtgatttgcaagtgcatgggggaagcagatccatccattcagcttcatggagcaaagcttctggaagaactgggcacaggcttaatacagcagtataaaccagactccactgcagcacctgatcagagagcaccagtcttcttggtggtgatgttctggactatgatgctgaacggtcctttacccagagccctgcagaattcagaacacccaactctccaggcgagcgcctgtgatgccctgtcttccatcttgccagaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacaggatgtcatatttgttgcagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaaggtaaaaagcaatgcagtccgggcccttggaaatttgcttcattttctgcaaccctctcatatagaaaaacccacatttgcagaaatcattgaggagtctatccaggccctaatttctactgttctaacagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaactggagacacagccagaagggccatcatgggctttttagaagagatcctggccgtttgttttgactcatctggatcacaaggggcactcccagggttaacaaatcagtgaagatcccaccatactttctagatgtcgaaggcggcagtaggaagacctgagcttgagcataagatctgtgggatttcatcttaggggcagaaacaatccgttcactatttatttagaatgacttagcagccatttaaattttcacagagggctcaaccacctttggagtgactccatagcactggccatggtcagggttgttggaacatctgacctgtgcatccaggagccgaggagtcaggttgtaatacaggccaagcagacgggctttgagggcatttagtctcagaaaaaaaaaatgtagaaggatttcggaattagaattttgtgtattgtatctgtagttttgtaataaactaacgaaaaatagtgtgtccacaatctcctgttgttaccaagttgtatttctagcaagctgcaagcagagctgcagttcagccagtttgtcctggcccagctgcacaggatgcgaggatgctgacagtgcctcacagccgcacaggaccgaggatgctgacggtgcctcacagccacacaggacgcgaggatgctgacggtgcctcacagccacacaggacgcgaggatgctgacagtgcctcacagccacacaggacgcgaggatgctgacggt

SEQ ID NO: 422885 - DNA, 3563 bp, Homo sapiens
  misc_feature (972)..(972): n is a, c, g, or t
cctgtgcttctcgaccaactttgaataaaaagaaaaaatccaaagtaaaaccaaagaaaatccagcaaggagaggaggaggaaaaggaattcagtggtgaaatagaggcagtcccagtcactggcacaggcagagtgaacctgcatgaagggaacacttggtgtcccttcttcctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaagtgccttgcaaatttagtatcaaatgcaccttatgatcgtctaaaactcagcctgctgaccaaagtctggaaccagataaagccttatattcgccacaaagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaancccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttacaggtattgactcttctggcaaggggctacttttcaatgactcaagcctacttgatggagcttggagaggtgatttgcaagtgcatgggggaagcagatccatccattcagcttcatggagcaaagcttctggaagaactgggcacaggcttaatacagcagtataaaccagactccactgcagcacctgatcagagagcaccagtcttcttggtggtgatgttctggactatgatgctgaacggtcctttacccagagccctgcagaattcagaacacccaactctccaggcgagcgcctgtgatgccctgtcttccatcttgccagaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacaggatgtcatatttgttgcagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaaggtaaaaagcaatgcagtccgggcccttggaaatttgcttcattttctgcaaccctctcatatagaaaaacccacatttgcagaaatcattgaggagtctatccaggccctaatttctactgttctaacagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaactggagacacagccagaagggccatcatgggctttttagaagagatcctggccgtttgttttgactcatctggatcacaaggggcactcccagggttaacaaatcagtgaagatcccaccatactttctagatgtcgaaggcggcagtaggaagacctgagcttgagcataagatctgtgggatttcatcttaggggcagaaacaatccgttcactatttatttagaatgacttagcagccatttaaattttcacagagggctcaaccacctttggagtgactccatagcactggccatggtcagggttgttggaacatctgacctgtgcatccaggagccgaggagtcaggttgtaatacaggccaagcagacgggctttgagggcatttagtctcagaaaaaaaaaatgtagaaggatttcggaattagaattttgtgtattgtatctgtagttttgtaataaactaacgaaaaataaaaaatataaaaaaaaaaaaaaaaaaaaaaaaaaaacaaaaaaagaaaaaacaaaaaaggggggggaccacaacaaagtgaactaccacgaagggggagcaaaaagataagcgcgacaccaccagacatgtacgctgaaaaagacgggaccccacaatagagagcaagcttcgagcacccaacgaccacgtcgccgcgcattaaggaaacagtcagctaagggaaacaccccgccttagctagagagaatactgtgcaacgagaacacttacaacagcggggcagcacacaacggggcaacaccactcctaccaggaggtagacgcccccaccgcggcccacttcacacactgagagcgcataaacagggtgcacacgcgaacgagctaggacaggcagcacgacaatccgggtcaccgggcatggcattaaaattactcggggggaccaaaacccccactctccctgatgagacgcggcagatagtaaaacatacgcgggccggacaaaccggatcacaacacacgacccgtgtagacgcgcagtgctcgcacgaatcaacgt

SEQ ID NO: 422886 - DNA, 3780 bp, Homo sapiens
gctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaatt

SEQ ID NO: 422887 - DNA, 4272 bp, Homo sapiens
gctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataaatagatgatcacaaaggggtgcttaa

SEQ ID NO: 422888 - DNA, 3709 bp, Homo sapiens
agcagtgtcaggactccctcacccgcaccccatctctttccgtgggctcatgggttccctctcatttgttaaattgcttatactttcccttcattggaacgagcccatttcccgaagcatcctagaggctttcagcagaactcggaggaatcaggatttaaagtggcggttgcacccgctccactttggttttcagctgggaggagagcgccctctccccgctccgcacctccgccaccccgcttctctcgtcaactggtggattatatcacttgaatactggggaaaaaccgagatcactttagtcgatgcagggcccacgtgataagcagatgttttaacgtgggtatgtttcttcttgcctccactcctccgtcccccacccccatcccttcctcatcctaggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataaatagatgatcacaaaggggtgcttaa

SEQ ID NO: 422889 - DNA, 4407 bp, Homo sapiens
gctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttatagggtaaggtgcacgcacccttgcgaatatctgtctaggctttggtttgatttttttcttctccagaaagtggtatggagctggcgagggcagagcccctccccgaatgggtgcctgatgctgatttctgttttgcagactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataaatagatgatcacaaaggggtgcttaa

SEQ ID NO: 422890 - DNA, 4232 bp, Homo sapiens
gctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatcccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataaatagatgatcacaaaggggtgcttaa

SEQ ID NO: 422891 - DNA, 3874 bp, Homo sapiens
gctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataaatagatgatcacaaaggggtgcttaa

SEQ ID NO: 422892 - DNA, 4218 bp, Homo sapiens
gctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctttttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataaatagatgatcacaaaggggtgcttaa

SEQ ID NO: 422893 - DNA, 4222 bp, Homo sapiens
gctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataaatagatgatcacaaaggggtgcttaa

SEQ ID NO: 422894 - DNA, 1652 bp, Homo sapiens
tgtacttttattattccttatttctctttcatcaaaacaaaacagcagctgtgggaggagaaatgagagggcttaaatgaaatctaaaataagctatattatacaaatactatctctgtatggttctgaccctggtaaatatatttcaaaacttcagatgagaagtttcaatatcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataaatagatgatcacaaaggggtgcttaa

SEQ ID NO: 422895 - DNA, 992 bp, Homo sapiens
gctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggtaagtcagttcagggaggccagc

SEQ ID NO: 422896 - DNA, 392 bp, Homo sapiens
atgaaacgagacgacaccaaggtaagtgtaagttcccgatattcctcataacctgcatgggtagttaattagagccattgatttcacagtgaagctctgcccgcaaatatattccagcccctgagcttccccaactgtgaattttaagtggcttgctgggtactctcagggggatattaaacatcatacctgaatttaaattgcattgcagaacagtccagaggaaagaggtttcttgggtgtagtttatcacatagtatgttttatggtgggggggcggggggggcagacgagggtaatatccaataagtgaatgtttcgcttactgttttctcttttccatgactctcatatattaaggatacctacaaattaccgcacagattaataga

SEQ ID NO: 422897 - DNA, 4758 bp, Homo sapiens
  misc_feature (1995)..(1995): n is a, c, g, or t
  misc_feature (2002)..(2002): n is a, c, g, or t
  misc_feature (2005)..(2005): n is a, c, g, or t
  misc_feature (2022)..(2022): n is a, c, g, or t
  misc_feature (2028)..(2028): n is a, c, g, or t
tcactttttgcttagcctgagccagtggtctgaagggatgggccagtctaagtctcagccacccggagcccatgccaggcccttagcaagactgagcatggcccaaagatgaggctgcacccctgggccacaggaagctttgttcagcacttcccacaatcaacttctgtgaacaaatgtagctaagattgtatattccttccataaggaataaaatgacctttaaagctatttcagagaagttttaaccccccacccccaccccatcctcccccaaatcttgccagcattgtatgagagcataaccagtgggaaccagcagggagcactctttgttggtccaaaatcctgtattcacagtgtagcaagctgtttgtgttcctcctgtggaaattgtagccaaaataaagcctttgtttttgtgattagaaatattttttttgcatataaaacaaacaaattaagaactatttgagcatgttggctctagtgaaggcttttgggggaagaggcagggtggccctctagcactgggaagctgcctcaactctgcttctacggattgggcaagtcactctctttcttggggtttcaatgtattttttaatggtcctttgtaggtctcattcccaatcaattatttcagctctctgatttctacctataaatttcctttatattgagggctgcctaggcaggatcgtccaggtctatcccagtttggggcagttgcttcaggggaatattcttggtttctctgtcataaggatgcacaaggctctggagtcatttccttggctttctgagcacagaagaattgtttgcataaggggaagccacttgctctcctctgtggctgggaatgcctgctctgaagagccctgccctaacctgccgggccaagggatggaggaaaagatggggtcagccagtggaagaagaggggcatcacttgggtccatgcctttatccatctgtccttctttcctctgacacacgtttgtgtggtggccactggtctaggccgggtcataaagctgcagcacacggacacccagtggtctcggggcatactagaggcacattcatcaagaagccacgaagaagggacaggggtccatgtgagctggggtgcgggggagaggatctctgaggtgacgttggagtgggcattagggcagacctagagtgcgtcctagattgcacgtgttctaaagtgacgtatgacagcatgggatattgaagctcacccgtctttcctgtgtggttcccgtcccagccagataccacagttccttggattggcaggcgcgctgtttcctgtcacacttaaagatctgcattgccacatgatctcacttttcacagctgttttatcaagcatgtcctttgtgcttctgatgtgctgagcatgctgcacacattatgtacttatttcatatgtatactagtgaagccctgtggggcgtggggagggttcttttcccattttacagaggagaaaacagaactgagaggggctaagaaatctacttataagatcactcagcttgtttaagtgaaggcaagttagttatataccagttatgtctagttccagaagtctcgattcctatgtctctcatacacggagccaccatcagatgtaagtaagtgagcagagtggattgtgtgtgcagagctgactttttggctcactgtataaccagcaggtataaggcatgagtagcattctagctgtaaattgtgaatgctagtggaaaagtgcttgtgggcatcccagttacggccctaagcaccctttcccaagtctgcttgatacaattttggtcaagccttcccgaataggttatatattcaggttgtaattttggcaggaaggcaaaacctggacactttgttatatactgtcccacctgttattccctcccagttttgagcctaacatttgctttgtgggacatgttcttcaagtggacaccttttttttttttnccagtanttnatttgcaaacctccttncctttncttttttcccccctttcctagtagcagaatcctgtttccaagtgaaatagtatgtggattccaatctgtgggtcacataaaagctttcttgaaggagcggtgaacacatagctcctgaaggctctggaagccacagtttataccccactgacctagtcactccctgtgcttcttggaggccgcggtggggcggttctcccagagcatttgctctgctgctgcccttgctgaatgcctgctcacccggtgatgaagcttagatgcactcactcagatttttctagagcttttgctccattcatttacatatcattttattaaaaacttactaagttcaaaacaatgttaaaataagttgtccctgcccttggggagctcagctaagtaggttttgtttttcatatttctgctgcaagtgcctccgatgcctgtctgttgctccttaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422898 - DNA, 810 bp, Homo sapiens
gaggagtggaataactagaagggagtggcagggcagcagcctggcccgagggaaggaagggtgcccttgacacattgggcgggtttggcagcttaactgtgactgactttcatttttttctgttacacgttgagaaaaaaactaaatgtgatttttccataaaaatgctgatacaaatgtccaaaacttttctatgttaaatagtcttttacatttttatgcatataggttacaacctgccatattcattcatccagtgatgatgaaattgactttaaagaaacgggtttctcacaggattcttctttgcagcaagtgagtcacgcctaaagctttgctttttgtttttattttaaatgcttagtttagttgccttttatgaatcagcttcagagtcagattatgtattagaatgtgatttggggttacttattagttagaccaaagcatttaaaataggaagtgctgggtaaatgaaagatagatttgtattggttatgtttcaagggattgttccatccctgataacagtgatgagtcaagtacattttcagaagatttgaatgaactgaatagttaagaaggcatctcacacatgcttgttacacagacctttacaatagttgagttgttgcttaaagatttgtgtagtagagatctgctggtaaaaataatagaaataagacgtttaaaatgtaagtaaaagtaaactctcacgaatacccctgatgtaagttctattatagttacatctaaagtaaatttttagttgaagtaattcattgcaacccctctctgcctgcccctgaa

SEQ ID NO: 422899 - DNA, 744 bp, Homo sapiens
cttaacccagagacttggtgctaaatattgctcttctcaatctttctgaagcttggaatgaacgtgctcttacagaaaatgtataaattccatccttcttaatctcccagccctctcttcttaagaactaacctacaaacccttttagtcctaaatgtctggaggtgacctcatggctaagaagctgatatatagaattttagtgtgtgggtattgtaatttggggagttgttggtactgttggccattgttaaaacaatatattcactggcattttccttgggggacttttaattttctgtagtgttcaaagtccagagaaacctgtaacattctacttaaaatgtgatggatatttccaagtatgttaatctacattggggcttgaacaagagccactcattgctatgattacttctacaatgtgttttacagtggttaaatgaggagaaaattatccagaggcttgtggaaatagttcatccatcgcaagaagaagatgtaagttcacttgtgtgactgtaaacttgattagaaaaaaaaaacaaaaaactgtttattgggcacagagcatacttatattaaatgtgaacatgatcagagcatacagggagaatagcagcgatctagtgttcttaaagttgatacttttctaaacaatattacattttgccaatactcagaaaatttccagaagtgtacaacagcaggcccttgttatagcaccatctcctttctagagcc

SEQ ID NO: 422900 - DNA, 438 bp, Homo sapiens
tcgaatgtctgtgcgtaatttgtgttcccattgcaacacggtctctcatgagagaccgtgttgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagcggccaattcacagattgcaagctcacaggtcg

SEQ ID NO: 422901 - DNA, 5520 bp, Homo sapiens
gccataggaaaggatatcttacaatatctttatggatgaatgcacacttcagtttaccttattgcagctaaaagtaagtgtaccccctgtcaagagagcatcccgttttacttggtttggctcattgacaaagtaagcaagctcctggtacaatttgagagccctgaaagcagcaatggggattctactatagctgtctagtgtaggaagattttcttggtcaagtttttgttgggggaaagaacagtccaaacctttgtgagctgtgtgttctcatcccagctacacgcacctgactgtatagaactttttgcagtttggccttctttggagatagcagtgtgtttttacgtgtggactaaagcaaaaatgaaaaactaggcacgtgccagtagaccaaatcagcctcctagcagagcacattgacattgtacaactttacagcctctgtcattggggtctggtttcaatttacttcatttcttaagagtttaaactggtttttataatttttccttatttctttgagtatcttggtttcacttatttgttcttttctatgtcttcttagatctaaaggaatgaagaattttaggatttgaagtgtcttaagtaatcatttagtctaaacctctcatttacagataagaaaacaagctcagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422902 - DNA, 5025 bp, Homo sapiens
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422903 - DNA, 4974 bp, Homo sapiens
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctatttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422904 - DNA, 5152 bp, Homo sapiens
gcctgcttgatacgtccgccattttgggcgcttcgctgatggtgtcggtgagcgcgtttcccgcctgagcgcaactagcggcgggtcgtgggcacctccagataagaaaacaagctcagagagatgtggtgacttgctcaaatagtgacagaacttcctcggccatatggaggggtcatataatacccttgtgtcttcagtttgaggtacctcccataattttaaggggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422905 - DNA, 4650 bp, Homo sapiens
cttaacccagagacttggtgctaaatattgctcttctcaatctttctgaagcttggaatgaacgtgctcttacagaaaatgtataaattccatccttcttaatctcccagccctctcttcttaagaactaacctacaaacccttttagtcctaaatgtctggaggtgacctcatggctaagaagctgatatatagaattttagtgtgtgggtattgtaatttggggagttgttggtactgttggccattgttaaaacaatatattcactggcattttccttgggggacttttaattttctgtagtgttcaaagtccagagaaacctgtaacattctacttaaaatgtgatggatatttccaagtatgttaatctacattggggcttgaacaagagccactcattgctatgattacttctacaatgtgttttacagtggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422906 - DNA, 4387 bp, Homo sapiens
agcggggtcatctgtgccacaggtccctgttgacagtgctgtactgtccaccacactagctgggatttattcctttgggctccaggtttggtgtttctggcactgaattacggaatacttgggacacatgtgacttttttcgtcctttctcctctactgtccttttaaaaacttgtgggatccaattattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422907 - DNA, 3789 bp, Homo sapiens
  misc_feature (17)..(17): n is a, c, g, or t
  misc_feature (23)..(23): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (68)..(68): n is a, c, g, or t
ttggttaaatcccagcnggtttnaaccaaatccccccgttaaaaagggncctttaggacctnaanaancttggagtcaattaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaaatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422908 - DNA, 4864 bp, Homo sapiens
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcaggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422909 - DNA, 3128 bp, Homo sapiens
gatgaggaaactcaggttatagatgaggttccttgtccaagtagtctacagctaggaagtggtgatgtcgatgtttgaatccaggaagcctcacctcagccaggctcatcacctatgttggcttcccattagagaacaaagaaacgatccaccagcaacaccacaagaaagtaatttttaaaacaaagcaaagcaaatagagcccaactgaggaaaacaagtgagtagagggtagagtgtgtaactgcctgctctgccccacactggaacagttaggagcacaagtgtctgctgggagaagctgggtatggaggtggacgctgagctgggagggatgtaggcgacttgctagtctctagtaaagaaaacccatgaaacccctctttagtgggcatctttaagaagtctctccccatcaagaatgtggcccagacaacagcaggcagaagccatctcactcttttttttcttcaagcagtagatgtcacgttgggtagatgggtttgtacagtggtggggtgccagttccttttcgggcttgctgtgtgtgaccatcagctgtgttcttttcagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422910 - DNA, 3954 bp, Homo sapiens
gccataggaaaggatatcttacaatatctttatggatgaatgcacacttcagtttaccttattgcagctaaaagtaagtgtaccccctgtcaagagagcatcccgttttacttggtttggctcattgacaaagtaagcaagctcctggtacaatttgagagccctgaaagcagcaatggggattctactatagctgtctagtgtaggaagattttcttggtcaagtttttgttgggggaaagaacagtccaaacctttgtgagctgtgtgttctcatcccagctacacgcacctgactgtatagaactttttgcagtttggccttctttggagatagcagtgtgtttttacgtgtggactaaagcaaaaatgaaaaactaggcacgtgccagtagaccaaatcagcctcctagcagagcacattgacattgtacaactttacagcctctgtcattggggtctggtttcaatttacttcatttcttaagagtttaaactggtttttataatttttccttatttctttgagtatcttggtttcacttatttgttcttttctatgtcttcttagatctaaaggaatgaagaattttaggatttgaagtgtcttaagtaatcatttagtctaaacctctcatttacagataagaaaacaagctcagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422911 - DNA, 7202 bp, Homo sapiens
  misc_feature (3882)..(3882): n is a, c, g, or t
  misc_feature (4313)..(4313): n is a, c, g, or t
  misc_feature (4666)..(4666): n is a, c, g, or t
  misc_feature (5878)..(5878): n is a, c, g, or t
  misc_feature (6815)..(6815): n is a, c, g, or t
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaatttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaaggtaaccaggggtgagatcctgctggtagcttcaggttattgggaggatggtggggcagaaacctcaaacattaaaatttttaatttgattcaaatgaatgttcagatactagcttgatgtctttctgttgtctccattaaacacaataaatcttaatgaagagatggagagtttaggcccctaagtgccttttcccccataaatgtgttcagaagactgtattttacatctagcagtttgatagaactatgagaattgataaatctttaatcacaatagaaattggcttgtgtaacaggctacagagcatggcccatgaaaaccggtttcaggtcgactggttttacaaaaacctttacttattttcagtaacatacagatgattatctcaggacataatgcagtcatgaaaattcagtagcaaaatgatagctttaaaagaacgtgacccttagaaattcacttctaaactcaaaaaaggaattgtaatgtatattaaaaacctaaaactgagagaataatgggaaaaatgtctgtcaaaacttaaggactgaagctaagcctgtgcttagagctttagtcttagagaccattccagccattacaagaaggaatgcctccctgcttattgcgaggtcactacaaaacaaggagtgaaagaagaaaactgattgtagactgatttcatacatgagcaattattctcaaaacttaagttaaagctagcaaaccaaatgtagcaatgtattttaaagtcatgaccaaggatatgtgctccagtgacacaatgtaaacaccagtgtgtacatggtaaaaattattcagagtaattcccagacaaaaggagaaaagcatttgattacaaattaaagctgttcatgattttctttgcagcctaggaatagaaagtaaataggtgaaactggtaagtatctctagaaaatctagagtagacttgattcttcagtgaggcattagaagtattccctttaaagacaagaaccagaaagtgggacctacagttgctatttgtcttcagcactgtgctggtggccttagcaaatgcagcattccaaataaataaatagtcgctgttgataggctatgatttatacataaaaattccaatggaatctgtagataaggattaatagaaaagtttagcaggtttactggagacatacaaaatcacttgcatcctataaatcaatataagatattccanatgtgcctgtttttaataaaaatgtaaaaccttatctataactaggaatatgacctttatgggaaaacagtttaaaatctcatggaatatattgaagacctgaatataaataccaagatttgccatgtttatcaatgtgaagatatttttagcatttctgaacaagttagtctatgaaattaatgaaatttccatcaaaatcccaatagagattttcatggaaattgagaaactgattgtaatagtcataagaccaaagagagccaggaatagccaaaaacattttaaagaaaaaagtgaggggcttcaccatattagatatcaagacttagtaaagctggccgagtgtggtggcttgcacctgtaatcccagcactttgggaggattaggcagacagattgcttgagcccaggagtttgagaccagcctnggcaacgtggcaaaatcctgtctctgcaaaaaatacaaaaattagctgagtgtggtggtgtgtgcctgtggtcccagctacttgggggtgctgaagtcgaggctgcagtgagctgtgtcccccactgcactccagcctgggggacaaaatgagaccctgtctcaaacaaaagcgaaaacaaaacttagtaaagctactgagatggtgtggctttggcaaagaattatacaaagagaccccctccactacatgaacttgttacatgttagaatgccattataattcaatgaggaaagagtggactagtaaatagtgattatccacatagtagaaaaataaaattagatattttntctcaacataaatatgaaaagcatgaactgtacagcttttagaagacaacaaaagagagtatctttacagtttgggtgtaaggcatttttttaaccataaaaagccaaaccataaaggaaaatcttggtaagtttgactttaatttctaatatcccagaagacataaaatgaaaagacaagccacaaccagtaaagaaccagtagccaggatattagaaataaccttatatcaatgagagatagtctaatttttttaaatggacaaaggatgcaaacaagcaactgtctgtggaggaaaacaaggagcaaaccaaatccagagtaaatgggacctgtcagttacagtagtaagtaaatgctatttcgtgctcaccagtctactaattcctatcttaagttgttagagaagatagaaaaagtacaaaacctgcccagctctttttatgagggcagtgaaatttgaattccaaaaccagataaagataattacagaaaatgatcagttcatgccacttacaggctactgaatgcaaaaatcctgtgtaaggtatttgctgactggatccaacagtgtattaaaaataatttataatgattagttagggtttatcctggaaggcaaggatggctcaaagtcagagaaatctgtcagtttaatctccatatatggtgttagacagaaagtcagtcatttgattttttttataaggttccatagctatatatgattaaaactctgagaaaaccagtaacagaagtgaatttatttttcttctttcctcctcttcctcctccctccttcctccttctttcttcttctttcttctttcttcttcaagatgagtgcagtgatgtggatctcggctcactgcaatctctgtctcctgggcttaagccatcctcccacctcaacctcccaagtaactgggactaggactacaggcacacgccaccatgctcagcaaatttatgtagtttttttttttttttttgtagtgatggggtttcaccatgttgcccaggctggtctcaaactcctgagctcaagcaatccacctgcctccacctcccaaagtgctgggattacagatgtgagccaccgcgcctggcaatgaatttcattaacttggtataagttaaataccaataccaaaatgctacagcaaaactaacacctaatgaggaaagtttagatgcattcactttaagangaagccttaaaggatgtccattttcattgccagtgttaggcagtcctggaaggaaaaggaaatagagttataggtaaagatcaggaggaagtgataaaactgttgttctttgcaggtggtaatgattacctacaaccaagtcagtagcaaacttgtaactaataagaattcagtaaagctattgagtaagaaatcagtttaaaaaatcagtagtctttttcttcatcagtagtaagcaaccagaacataaaaagcaaggtattattccaaaatacatcaaaatataaattattcaggaatgatcttaacccaagtctctatagagaaatctggacaagtggagaccatggcatagcttagtgctgcagagacatctgccatcctgaagttagtgtttaacgcagtctcaatccaaatttcagttggatttttagaagtaacttaatactctaaaatttatatggaaaaatgaaggttcccaaattgcttagaggtaaccaaaagggaagattgaaaaagggacttgccctgccagatagtcacgctgcaaagtcacagtgattggaacagttttgatattagtgtccaaacaggtacaggtgtcagtgtgatgaaatagagggattaataatggggaagggagaggaagggctggttcaccaaaaggaaaagtcaggcaagatcctccctaatctacattctaaaacaactccagctggattaaaagacaataagaaaaacatgtgcagtgctttctgtggaccaggccctgctctctacactctccatgtgtggtagctcatggattattcttaggaaccctataagataggtactgggattattatccctgcttttcaggtgaggaaactgaggcactagagttaagtgatgaggccggaggccagagtctcatgatggttaataaaagaaatanagaatgtctttttaacctgtgtgcagaaagggacttctgtatctatctcatctgtctgtcatctatctatctatctgtctgtctgcctatctaatctatcatctgtcagtctatatctaatctagatttttttttttttaacacgaggtctcgctctgttgcccaggctggaatgcagtggcacaatcatagctcactgtaacttccaactcctgagctccagcagtcctcccacctcagtatcccaagtagctggaactacagttgtgtgccaccactcctggcttaatttttttgtttgtttacttttttatttttgtggcccaggctgatctcaaactcctggcttcaagtgagcctccttcctcggcaggacttctttaaaaa

SEQ ID NO: 422912 - DNA, 4575 bp, Homo sapiens
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaatgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422913 - DNA, 680 bp, Homo sapiens
ctgttctagaggatcacctgactgtgaaagaatccgcttgacgctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422914 - DNA, 568 bp, Homo sapiens
gtagatctagaggatcccttgctctgtggtactcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaatcttgtacc

SEQ ID NO: 422915 - DNA, 3684 bp, Homo sapiens
  misc_feature (3625)..(3625): n is a, c, g, or t
  misc_feature (3628)..(3628): n is a, c, g, or t
  misc_feature (3645)..(3645): n is a, c, g, or t
  misc_feature (3648)..(3648): n is a, c, g, or t
  misc_feature (3652)..(3652): n is a, c, g, or t
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatngantgcttaccatttagganctngaanggggtcttagagactgaacccggctccctttg

SEQ ID NO: 422916 - DNA, 7097 bp, Homo sapiens
  misc_feature (3846)..(3846): n is a, c, g, or t
  misc_feature (4277)..(4277): n is a, c, g, or t
  misc_feature (4630)..(4630): n is a, c, g, or t
  misc_feature (5842)..(5842): n is a, c, g, or t
  misc_feature (6779)..(6779): n is a, c, g, or t
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaaggtaaccaggggtgagatcctgctggtagcttcaggttattgggaggatggtggggcagaaacctcaaacattaaaatttttaatttgattcaaatgaatgttcagatactagcttgatgtctttctgttgtctccattaaacacaataaatcttaatgaagagatggagagtttaggcccctaagtgccttttcccccataaatgtgttcagaagactgtattttacatctagcagtttgatagaactatgagaattgataaatctttaatcacaatagaaattggcttgtgtaacaggctacagagcatggcccatgaaaaccggtttcaggtcgactggttttacaaaaacctttacttattttcagtaacatacagatgattatctcaggacataatgcagtcatgaaaattcagtagcaaaatgatagctttaaaagaacgtgacccttagaaattcacttctaaactcaaaaaaggaattgtaatgtatattaaaaacctaaaactgagagaataatgggaaaaatgtctgtcaaaacttaaggactgaagctaagcctgtgcttagagctttagtcttagagaccattccagccattacaagaaggaatgcctccctgcttattgcgaggtcactacaaaacaaggagtgaaagaagaaaactgattgtagactgatttcatacatgagcaattattctcaaaacttaagttaaagctagcaaaccaaatgtagcaatgtattttaaagtcatgaccaaggatatgtgctccagtgacacaatgtaaacaccagtgtgtacatggtaaaaattattcagagtaattcccagacaaaaggagaaaagcatttgattacaaattaaagctgttcatgattttctttgcagcctaggaatagaaagtaaataggtgaaactggtaagtatctctagaaaatctagagtagacttgattcttcagtgaggcattagaagtattccctttaaagacaagaaccagaaagtgggacctacagttgctatttgtcttcagcactgtgctggtggccttagcaaatgcagcattccaaataaataaatagtcgctgttgataggctatgatttatacataaaaattccaatggaatctgtagataaggattaatagaaaagtttagcaggtttactggagacatacaaaatcacttgcatcctataaatcaatataagatattccanatgtgcctgtttttaataaaaatgtaaaaccttatctataactaggaatatgacctttatgggaaaacagtttaaaatctcatggaatatattgaagacctgaatataaataccaagatttgccatgtttatcaatgtgaagatatttttagcatttctgaacaagttagtctatgaaattaatgaaatttccatcaaaatcccaatagagattttcatggaaattgagaaactgattgtaatagtcataagaccaaagagagccaggaatagccaaaaacattttaaagaaaaaagtgaggggcttcaccatattagatatcaagacttagtaaagctggccgagtgtggtggcttgcacctgtaatcccagcactttgggaggattaggcagacagattgcttgagcccaggagtttgagaccagcctnggcaacgtggcaaaatcctgtctctgcaaaaaatacaaaaattagctgagtgtggtggtgtgtgcctgtggtcccagctacttgggggtgctgaagtcgaggctgcagtgagctgtgtcccccactgcactccagcctgggggacaaaatgagaccctgtctcaaacaaaagcgaaaacaaaacttagtaaagctactgagatggtgtggctttggcaaagaattatacaaagagaccccctccactacatgaacttgttacatgttagaatgccattataattcaatgaggaaagagtggactagtaaatagtgattatccacatagtagaaaaataaaattagatattttntctcaacataaatatgaaaagcatgaactgtacagcttttagaagacaacaaaagagagtatctttacagtttgggtgtaaggcatttttttaaccataaaaagccaaaccataaaggaaaatcttggtaagtttgactttaatttctaatatcccagaagacataaaatgaaaagacaagccacaaccagtaaagaaccagtagccaggatattagaaataaccttatatcaatgagagatagtctaatttttttaaatggacaaaggatgcaaacaagcaactgtctgtggaggaaaacaaggagcaaaccaaatccagagtaaatgggacctgtcagttacagtagtaagtaaatgctatttcgtgctcaccagtctactaattcctatcttaagttgttagagaagatagaaaaagtacaaaacctgcccagctctttttatgagggcagtgaaatttgaattccaaaaccagataaagataattacagaaaatgatcagttcatgccacttacaggctactgaatgcaaaaatcctgtgtaaggtatttgctgactggatccaacagtgtattaaaaataatttataatgattagttagggtttatcctggaaggcaaggatggctcaaagtcagagaaatctgtcagtttaatctccatatatggtgttagacagaaagtcagtcatttgattttttttataaggttccatagctatatatgattaaaactctgagaaaaccagtaacagaagtgaatttatttttcttctttcctcctcttcctcctccctccttcctccttctttcttcttctttcttctttcttcttcaagatgagtgcagtgatgtggatctcggctcactgcaatctctgtctcctgggcttaagccatcctcccacctcaacctcccaagtaactgggactaggactacaggcacacgccaccatgctcagcaaatttatgtagtttttttttttttttttgtagtgatggggtttcaccatgttgcccaggctggtctcaaactcctgagctcaagcaatccacctgcctccacctcccaaagtgctgggattacagatgtgagccaccgcgcctggcaatgaatttcattaacttggtataagttaaataccaataccaaaatgctacagcaaaactaacacctaatgaggaaagtttagatgcattcactttaagangaagccttaaaggatgtccattttcattgccagtgttaggcagtcctggaaggaaaaggaaatagagttataggtaaagatcaggaggaagtgataaaactgttgttctttgcaggtggtaatgattacctacaaccaagtcagtagcaaacttgtaactaataagaattcagtaaagctattgagtaagaaatcagtttaaaaaatcagtagtctttttcttcatcagtagtaagcaaccagaacataaaaagcaaggtattattccaaaatacatcaaaatataaattattcaggaatgatcttaacccaagtctctatagagaaatctggacaagtggagaccatggcatagcttagtgctgcagagacatctgccatcctgaagttagtgtttaacgcagtctcaatccaaatttcagttggatttttagaagtaacttaatactctaaaatttatatggaaaaatgaaggttcccaaattgcttagaggtaaccaaaagggaagattgaaaaagggacttgccctgccagatagtcacgctgcaaagtcacagtgattggaacagttttgatattagtgtccaaacaggtacaggtgtcagtgtgatgaaatagagggattaataatggggaagggagaggaagggctggttcaccaaaaggaaaagtcaggcaagatcctccctaatctacattctaaaacaactccagctggattaaaagacaataagaaaaacatgtgcagtgctttctgtggaccaggccctgctctctacactctccatgtgtggtagctcatggattattcttaggaaccctataagataggtactgggattattatccctgcttttcaggtgaggaaactgaggcactagagttaagtgatgaggccggaggccagagtctcatgatggttaataaaagaaatanagaatgtctttttaacctgtgtgcagaaagggacttctgtatctatctcatctgtctgtcatctatctatctatctgtctgtctgcctatctaatctatcatctgtcagtctatatctaatctagatttttttttttttaacacgaggtctcgctctgttgcccaggctggaatgcagtggcacaatcatagctcactgtaacttccaatcctggcttaatttttttgtttgtttacttttttatttttgtggcccaggctgatctcaaactcctggcttcaagtgagcctccttcctcggcaggacttctttaaaaa

SEQ ID NO: 422917 - DNA, 3302 bp, Homo sapiens
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttccctgctacgaaagacaaaaaaaaaaa

SEQ ID NO: 422918 - DNA, 5269 bp, Homo sapiens
  misc_feature (1949)..(1949): n is a, c, g, or t
  misc_feature (2380)..(2380): n is a, c, g, or t
  misc_feature (2733)..(2733): n is a, c, g, or t
  misc_feature (3945)..(3945): n is a, c, g, or t
  misc_feature (4882)..(4882): n is a, c, g, or t
gatgaggaaactcaggttatagatgaggttccttgtccaagtagtctacagctaggaagtggtgatgtcgatgtttgaatccaggaagcctcacctcagccaggctcatcacctatgttggcttcccattagagaacaaagaaacgatccaccagcaacaccacaagaaagtaatttttaaaacaaagcaaagcaaatagagcccaactgaggaaaacaagtgagtagagggtagagtgtgtaactgcctgctctgccccacactggaacagttaggagcacaagtgtctgctgggagaagctgggtatggaggtggacgctgagctgggagggatgtaggcgacttgctagtctctagtaaagaaaacccatgaaacccctctttagtgggcatctttaagaagtctctccccatcaagaatgtggcccagacaacagcaggcagaagccatctcactcttttttttcttcaagcagtagatgtcacgttgggtagatgggtttgtacagtggtggggtgccagttccttttcgggcttgctgtgtgtgaccatcagctgtgttcttttcagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaaggtaaccaggggtgagatcctgctggtagcttcaggttattgggaggatggtggggcagaaacctcaaacattaaaatttttaatttgattcaaatgaatgttcagatactagcttgatgtctttctgttgtctccattaaacacaataaatcttaatgaagagatggagagtttaggcccctaagtgccttttcccccataaatgtgttcagaagactgtattttacatctagcagtttgatagaactatgagaattgataaatctttaatcacaatagaaattggcttgtgtaacaggctacagagcatggcccatgaaaaccggtttcaggtcgactggttttacaaaaacctttacttattttcagtaacatacagatgattatctcaggacataatgcagtcatgaaaattcagtagcaaaatgatagctttaaaagaacgtgacccttagaaattcacttctaaactcaaaaaaggaattgtaatgtatattaaaaacctaaaactgagagaataatgggaaaaatgtctgtcaaaacttaaggactgaagctaagcctgtgcttagagctttagtcttagagaccattccagccattacaagaaggaatgcctccctgcttattgcgaggtcactacaaaacaaggagtgaaagaagaaaactgattgtagactgatttcatacatgagcaattattctcaaaacttaagttaaagctagcaaaccaaatgtagcaatgtattttaaagtcatgaccaaggatatgtgctccagtgacacaatgtaaacaccagtgtgtacatggtaaaaattattcagagtaattcccagacaaaaggagaaaagcatttgattacaaattaaagctgttcatgattttctttgcagcctaggaatagaaagtaaataggtgaaactggtaagtatctctagaaaatctagagtagacttgattcttcagtgaggcattagaagtattccctttaaagacaagaaccagaaagtgggacctacagttgctatttgtcttcagcactgtgctggtggccttagcaaatgcagcattccaaataaataaatagtcgctgttgataggctatgatttatacataaaaattccaatggaatctgtagataaggattaatagaaaagtttagcaggtttactggagacatacaaaatcacttgcatcctataaatcaatataagatattccanatgtgcctgtttttaataaaaatgtaaaaccttatctataactaggaatatgacctttatgggaaaacagtttaaaatctcatggaatatattgaagacctgaatataaataccaagatttgccatgtttatcaatgtgaagatatttttagcatttctgaacaagttagtctatgaaattaatgaaatttccatcaaaatcccaatagagattttcatggaaattgagaaactgattgtaatagtcataagaccaaagagagccaggaatagccaaaaacattttaaagaaaaaagtgaggggcttcaccatattagatatcaagacttagtaaagctggccgagtgtggtggcttgcacctgtaatcccagcactttgggaggattaggcagacagattgcttgagcccaggagtttgagaccagcctnggcaacgtggcaaaatcctgtctctgcaaaaaatacaaaaattagctgagtgtggtggtgtgtgcctgtggtcccagctacttgggggtgctgaagtcgaggctgcagtgagctgtgtcccccactgcactccagcctgggggacaaaatgagaccctgtctcaaacaaaagcgaaaacaaaacttagtaaagctactgagatggtgtggctttggcaaagaattatacaaagagaccccctccactacatgaacttgttacatgttagaatgccattataattcaatgaggaaagagtggactagtaaatagtgattatccacatagtagaaaaataaaattagatattttntctcaacataaatatgaaaagcatgaactgtacagcttttagaagacaacaaaagagagtatctttacagtttgggtgtaaggcatttttttaaccataaaaagccaaaccataaaggaaaatcttggtaagtttgactttaatttctaatatcccagaagacataaaatgaaaagacaagccacaaccagtaaagaaccagtagccaggatattagaaataaccttatatcaatgagagatagtctaatttttttaaatggacaaaggatgcaaacaagcaactgtctgtggaggaaaacaaggagcaaaccaaatccagagtaaatgggacctgtcagttacagtagtaagtaaatgctatttcgtgctcaccagtctactaattcctatcttaagttgttagagaagatagaaaaagtacaaaacctgcccagctctttttatgagggcagtgaaatttgaattccaaaaccagataaagataattacagaaaatgatcagttcatgccacttacaggctactgaatgcaaaaatcctgtgtaaggtatttgctgactggatccaacagtgtattaaaaataatttataatgattagttagggtttatcctggaaggcaaggatggctcaaagtcagagaaatctgtcagtttaatctccatatatggtgttagacagaaagtcagtcatttgattttttttataaggttccatagctatatatgattaaaactctgagaaaaccagtaacagaagtgaatttatttttcttctttcctcctcttcctcctccctccttcctccttctttcttcttctttcttctttcttcttcaagatgagtgcagtgatgtggatctcggctcactgcaatctctgtctcctgggcttaagccatcctcccacctcaacctcccaagtaactgggactaggactacaggcacacgccaccatgctcagcaaatttatgtagtttttttttttttttttgtagtgatggggtttcaccatgttgcccaggctggtctcaaactcctgagctcaagcaatccacctgcctccacctcccaaagtgctgggattacagatgtgagccaccgcgcctggcaatgaatttcattaacttggtataagttaaataccaataccaaaatgctacagcaaaactaacacctaatgaggaaagtttagatgcattcactttaagangaagccttaaaggatgtccattttcattgccagtgttaggcagtcctggaaggaaaaggaaatagagttataggtaaagatcaggaggaagtgataaaactgttgttctttgcaggtggtaatgattacctacaaccaagtcagtagcaaacttgtaactaataagaattcagtaaagctattgagtaagaaatcagtttaaaaaatcagtagtctttttcttcatcagtagtaagcaaccagaacataaaaagcaaggtattattccaaaatacatcaaaatataaattattcaggaatgatcttaacccaagtctctatagagaaatctggacaagtggagaccatggcatagcttagtgctgcagagacatctgccatcctgaagttagtgtttaacgcagtctcaatccaaatttcagttggatttttagaagtaacttaatactctaaaatttatatggaaaaatgaaggttcccaaattgcttagaggtaaccaaaagggaagattgaaaaagggacttgccctgccagatagtcacgctgcaaagtcacagtgattggaacagttttgatattagtgtccaaacaggtacaggtgtcagtgtgatgaaatagagggattaataatggggaagggagaggaagggctggttcaccaaaaggaaaagtcaggcaagatcctccctaatctacattctaaaacaactccagctggattaaaagacaataagaaaaacatgtgcagtgctttctgtggaccaggccctgctctctacactctccatgtgtggtagctcatggattattcttaggaaccctataagataggtactgggattattatccctgcttttcaggtgaggaaactgaggcactagagttaagtgatgaggccggaggccagagtctcatgatggttaataaaagaaatanagaatgtctttttaacctgtgtgcagaaagggacttctgtatctatctcatctgtctgtcatctatctatctatctgtctgtctgcctatctaatctatcatctgtcagtctatatctaatctagatttttttttttttaacacgaggtctcgctctgttgcccaggctggaatgcagtggcacaatcatagctcactgtaacttccaactcctgagctccagcagtcctcccacctcagtatcccaagtagctggaactacagttgtgtgccaccactcctggcttaatttttttgtttgtttacttttttatttttgtggcccaggctgatctcaaactcctggcttcaagtgagcctccttcctcggcaggacttctttaaaaa

SEQ ID NO: 422919 - DNA, 1920 bp, Homo sapiens
gccataggaaaggatatcttacaatatctttatggatgaatgcacacttcagtttaccttattgcagctaaaagtaagtgtaccccctgtcaagagagcatcccgttttacttggtttggctcattgacaaagtaagcaagctcctggtacaatttgagagccctgaaagcagcaatggggattctactatagctgtctagtgtaggaagattttcttggtcaagtttttgttgggggaaagaacagtccaaacctttgtgagctgtgtgttctcatcccagctacacgcacctgactgtatagaactttttgcagtttggccttctttggagatagcagtgtgtttttacgtgtggactaaagcaaaaatgaaaaactaggcacgtgccagtagaccaaatcagcctcctagcagagcacattgacattgtacaactttacagcctctgtcattggggtctggtttcaatttacttcatttcttaagagtttaaactggtttttataatttttccttatttctttgagtatcttggtttcacttatttgttcttttctatgtcttcttagatctaaaggaatgaagaattttaggatttgaagtgtcttaagtaatcatttagtctaaacctctcatttacagataagaaaacaagctcagagagatgtggtgacttgctcaaatagtgacagaacttcctcggccatatggaggggtcatataatacccttgtgtcttcagtttgaggtacctcccataattttaaggggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattgttcaaagtccagagaaacctgtaacattctacttaaaatgtgatggatatttccaagtatgttaatctacattggggcttgaacaagagccactcattgctatgattacttctacaatgtgttttacagtggttaaatgaggagaaaattatccagaggcttgtggaaatagttcatccatcgcaagaagaagatgtaagttcacttgtgtgactgtaaacttgattagaaaaaaaaaacaaaaaactgtttattgggcacagagcatacttatattaaatgtgaacatgatcagagcatacagggagaatagcagcgatctagtgttcttaaagttgatacttttctaaacaatattacattttgccaatactcagaaaatttccagaagtgtacaacagcaggcccttgttatagcaccatctcctttctagagcc

SEQ ID NO: 422920 - DNA, 1119 bp, Homo sapiens
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatgtaagttcacttgtgtgactgtaaacttgattagaaaaaaaaaacaaaaaactgtttattgggcacagagcatacttatattaaatgtgaacatgatcagagcatacagggagaatagcagcgatctagtgttcttaaagttgatacttttctaaacaatattacattttgccaatactcagaaaatttccagaagtgtacaacagcaggcccttgttatagcaccatctcctttctagagcc

SEQ ID NO: 422921 - DNA, 1556 bp, Homo sapiens
gccataggaaaggatatcttacaatatctttatggatgaatgcacacttcagtttaccttattgcagctaaaagtaagtgtaccccctgtcaagagagcatcccgttttacttggtttggctcattgacaaagtaagcaagctcctggtacaatttgagagccctgaaagcagcaatggggattctactatagctgtctagtgtaggaagattttcttggtcaagtttttgttgggggaaagaacagtccaaacctttgtgagctgtgtgttctcatcccagctacacgcacctgactgtatagaactttttgcagtttggccttctttggagatagcagtgtgtttttacgtgtggactaaagcaaaaatgaaaaactaggcacgtgccagtagaccaaatcagcctcctagcagagcacattgacattgtacaactttacagcctctgtcattggggtctggtttcaatttacttcatttcttaagagtttaaactggtttttataatttttccttatttctttgagtatcttggtttcacttatttgttcttttctatgtcttcttagatctaaaggaatgaagaattttaggatttgaagtgtcttaagtaatcatttagtctaaacctctcatttacagataagaaaacaagctcagagagatgtggtgacttgctcaaatagtgacagaacttcctcggccatatggaggggtcatataatacccttgtgtcttcagtttgaggtacctcccataattttaaggggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaaggtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatgtaagttcacttgtgtgactgtaaacttgattagaaaaaaaaaacaaaaaactgtttattgggcacagagcatacttatattaaatgtgaacatgatcagagcatacagggagaatagcagcgatctagtgttcttaaagttgatacttttctaaacaatattacattttgccaatactcagaaaatttccagaagtgtacaacagcaggcccttgttatagcaccatctcctttctagagcc

SEQ ID NO: 422922 - DNA, 296 bp, Homo sapiens
ccttatttctttgagtatcttggtttcacttatttgttcttttctatgtcttcttagatctaaaggaatgaagaattttaggatttgaagtgtcttaagtaatcatttagtctaaacctctcatttacagataagaaaacaagctcagagagatgtggtgacttgctcaaatagtgacagaacttcctcggccatatggaggggtcatataatacccttgtgtcttcagtttgaggtacctcccataattttaaggggtatgtggctttaattacattactactgtttgaatgaag

SEQ ID NO: 422923 - DNA, 453 bp, Homo sapiens
tctgtttgttttttatttatagagattttgatgatagtgtaaatatcttaaatttggaaactttcataaatacggtttctgtgagctgatagtaattaatgcttcctacacttttattttgtttttttacagtgtttcttttgatcgagtatcagacatcaactttactctcaatacaaatgaaagtgtaagtataaactctgttgtgagcagtgtggcacatgagaggttaaaaattgggtgagtccctgtgtggatgccacatgctgggacccctgtgctctagagccctaatcctaaattggtgttacatacttcactctgtcccacggcctacctggcacccgtgggcatgtgatttttgcagccctggtttatgacttggtggagctaataagaccagggtcacttgtgattgcagcgtagacacttgacttcaaagagaaggctgca

SEQ ID NO: 422924 - DNA, 2385 bp, Homo sapiens
gcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagtgagtcacgcctaaagctttgctttttgtttttattttaaatgcttagtttagttgccttttatgaatcagcttcagagtcagattatgtattagaatgtgatttggggttacttattagttagaccaaagcatttaaaataggaagtgctgggtaaatgaaagatagatttgtattggttatgtttcaagggattgttccatccctgataacagtgatgagtcaagtacattttcagaagatttgaatgaactgaatagttaagaaggcatctcacacatgcttgttacacagacctttacaatagttgagttgttgcttaaagatttgtgtagtagagatctgctggtaaaaataatagaaataagacgtttaaaatgtaagtaaaagtaaactctcacgaatacccctgatgtaagttctattatagttacatctaaagtaaatttttagttgaagtaattcattgcaacccctctctgcctgcccctgaa

SEQ ID NO: 422925 - DNA, 3788 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagttccaaacaggtttctctcctgttccccagccttgccttcatgatgcaggcccaattgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggtgagcca

SEQ ID NO: 422926 - DNA, 3154 bp, Homo sapiens
  misc_feature (3080)..(3080): n is a, c, g, or t
  misc_feature (3088)..(3088): n is a, c, g, or t
  misc_feature (3146)..(3146): n is a, c, g, or t
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgccccaatgcatccccaccccccgcccctccggacggcttacttancctcatanggcagctcatcttaaaccaatagaatcgctcgggtgggacgagagtgtctgactcagnatatctat

SEQ ID NO: 422927 - DNA, 3649 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggtatgtgggccccccccggattgctcaactctgggaacagaaccctgttcattatagggctagagtgtgacaacttggggccctgaggaaagtaaggagtcagggggactggggaaggaaccaaagcctgggaacttggctctccaggaagcaccaggaggactgagcactgggtattggggtctctgggtccctaagtccactcgcctgcatgctaggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggaaaaaatacgacaaaaaggggggggggttaaatattgctacgaggggccagttaaggggtaccagtatatgtacaaggaccctaggggggatattacgataggccggccggtacaagtaggagggaacggactgggacttgagaccaatcggggatatggcatcccggtagcagggtataggtagtacggataggtcgagagattataaggtac

SEQ ID NO: 422928 - DNA, 3300 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagttccaaacaggtttctctcctgttccccagccttgccttcatgatgcaggcccaattgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggtgagcca

SEQ ID NO: 422929 - DNA, 3038 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggtcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggaaaaaatacgacaaaaaggggggggggttaaatattgctacgaggggccagttaaggggtaccagtatatgtacaaggaccctaggggggatattacgataggccggccggtacaagtaggagggaacggactgggacttgagaccaatcggggatatggcatcccggtagcagggtataggtagtacggataggtcgagagattataaggtac

SEQ ID NO: 422930 - DNA, 2295 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttttcttttctttcttgtcttttttttttttttttttttttt

SEQ ID NO: 422931 - DNA, 1570 bp, Homo sapiens
  misc_feature (1324)..(1324): n is a, c, g, or t
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggtggatcccactgtcaccccngctgactgttttgcacacttcctgcttttgttcccacttcctatctaggcaggatcatagcagagagggggccttttggggtgagagggaccgagctgagataggctggagatgtcaggggacagaggccattccagtgatcttagttctgcctttcttcccacgggtggccaaggaacagcctgctctttctgtgtgttggaatgttattttgtggataattggagtatagtagcatgtccccac

SEQ ID NO: 422932 - DNA, 974 bp, Homo sapiens
  misc_feature (922)..(922): n is a, c, g, or t
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagtgagtgcccccactccgggaccccacacagacccagcaaaccccgttcacatgttctgaatcttctgggagccccccccaactccagggccctctccaggatccaacagctctcttctctccttattcctgggagcccatagaaaagtgatccctctcaaacctcccttcacccccaggccctgaaaccttcacagagggaacccccggtggcccggctccccactcctaaccttttgccgacccctgcagtctcctggaacagccccatccccgggagccccctctggctcccagactaagaaactgttcttgggctacgttatcttctcccctaactctccacccagccccctcattctctccagatgtggagacctccacaccctctccagagcccctaaagctcctacctctgaccncagcttctctctgattcccacaggccccatgcatcctccctgcctcactccc

SEQ ID NO: 422933 - DNA, 3431 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggaaaaaatacgacaaaaaggggggggggttaaatattgctacgaggggccagttaaggggtaccagtatatgtacaaggaccctaggggggatattacgataggccggccggtacaagtaggagggaacggactgggacttgagaccaatcggggatatggcatcccggtagcagggtataggtagtacggataggtcgagagattataaggtac

SEQ ID NO: 422934 - DNA, 3342 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggaaaaaatacgacaaaaaggggggggggttaaatattgctacgaggggccagttaaggggtaccagtatatgtacaaggaccctaggggggatattacgataggccggccggtacaagtaggagggaacggactgggacttgagaccaatcggggatatggcatcccggtagcagggtataggtagtacggataggtcgagagattataaggtac

SEQ ID NO: 422935 - DNA, 3362 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagggctccccactcaccaatcctaggcccccccagctatggacgaacggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggaaaaaatacgacaaaaaggggggggggttaaatattgctacgaggggccagttaaggggtaccagtatatgtacaaggaccctaggggggatattacgataggccggccggtacaagtaggagggaacggactgggacttgagaccaatcggggatatggcatcccggtagcagggtataggtagtacggataggtcgagagattataaggtac

SEQ ID NO: 422936 - DNA, 3087 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgcttggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagttccaaacaggtttctctcctgttccccagccttgccttcatgatgcaggcccaattgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggtgagcca

SEQ ID NO: 422937 - DNA, 1405 bp, Homo sapiens
tcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcagctctggcgggtcttcatctctcaggatctggggactgttctgggatgctggtcaggagatctatctgtcccagggatcattcgacctcgatgggcagcggct

SEQ ID NO: 422938 - DNA, 353 bp, Homo sapiens
cagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccaggtgggcccagggaccccaggctggcccccagcactgggctccttcccattcctctccaagaccctgagctgccatgctgcacaacatggtactccatgacaatggtgactctggggtcatgccatgtgacagccctgccaggacatcaacatcctcctcaccgctcttctccctcctctgtagacgaaagcgccgtaacttcagcaa

SEQ ID NO: 422939 - DNA, 673 bp, Homo sapiens
attaggaattctcattttaaaattaaggtctttttgtgacttttaccatggattattattttcccaaatacatgaccctgtttgattagcatatagagttttgacccagggagaggatgcagtgcccagcttctcagtggttaacagctgttcagcctagtgcatatcagaatttatgtgggtgttgaatgatttttttaaactagtgtaggaacacttgataccttctcagtagttatgtgcatgtttctgtagtttcccaagctaatgggagagatcttcaaaatgatgaaattttattgaaatcaaatagatacattaagaaatggaaatgctgaatagagcctagtttgctctacatgctctttggcaaattgttgggtcactgagacattttaagatagcaatataggccaggtgcagtggctcacacctataatccagcacttttgggaggctgaggcttgagcccaggaggttgagaccagcctgggcaacatagcaggcccctgtcgctaccaaaaaaaaaaaaaaaaaaaaaaaaaagccaggcatggtggggcatgcctgtagtcccagctacttgggaggctcgcttgagccagtaaagtcaaggctgaaatgagccatgattatggctccgtactccagtctgggcaacagagttgagact

SEQ ID NO: 422940 - DNA, 451 bp, Homo sapiens
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggtaaaagcgaccctcagtttcccccagtcctgctcattttggtcacgcctctttgaagtcagctgtgcagaaacccgcgacggatgggcgccagacggggctctggaggctttggggagttgtagtctccggccatgcccttgaggatcttaggcaagtgaggggcaggggatcaggaggatgatcctgatgtaacagatgctcgaagtgggtagaattgagcagacaagggtctctgagttgaggattagggagtgggtacgagttccttgggaaaagatggaggccgggcgcgg

SEQ ID NO: 422941 - DNA, 3006 bp, Homo sapiens
  misc_feature (1220)..(1220): n is a, c, g, or t
  misc_feature (1276)..(1276): n is a, c, g, or t
  misc_feature (1312)..(1312): n is a, c, g, or t
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagagattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgactggtaagggggccaggcacactgtcatgctgaggcggntatcagggagaattggctgggactgcaataccaagcctcaggtggctaaggagggngcggggaaggatgggtggaatgagaggcatgggctntcctgcttaaaagaaggatctggtgcccttctctctcccttctcagcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422942 - DNA, 3225 bp, Homo sapiens
  misc_feature (1439)..(1439): n is a, c, g, or t
  misc_feature (1495)..(1495): n is a, c, g, or t
  misc_feature (1531)..(1531): n is a, c, g, or t
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatggtggggagtgcagggaccgggcccagggatcgaggctggtaccctgggagggctgaccctcagatgcaccccgctctcatgtcctttctttcctgtctctttctccctcctgacagattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgactggtaagggggccaggcacactgtcatgctgaggcggntatcagggagaattggctgggactgcaataccaagcctcaggtggctaaggagggngcggggaaggatgggtggaatgagaggcatgggctntcctgcttaaaagaaggatctggtgcccttctctctcccttctcagcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422943 - DNA, 2928 bp, Homo sapiens
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422944 - DNA, 2898 bp, Homo sapiens
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacaggaaactctgagaggtgggtcccagcctgacgcagcccgagagctccgctcttgccttctccacctcacactgggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422945 - DNA, 1056 bp, Homo sapiens
acggcagtgcacgcgtgcattgcgtgatagctctgttctagagtatccccccggtctccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422946 - DNA, 2810 bp, Homo sapiens
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422947 - DNA, 1516 bp, Homo sapiens
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactggaagatgggtcaagaggaagagagccctccaagagaggagaggccccagcagagtccaaaggtacaggagaaggatttggggaggctgagacctcaagacctgcttgactttgctccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422948 - DNA, 355 bp, Homo sapiens
gagctggtggctgaggaggagcgcatgaaacagaaagcagagaaaaagcgactcaagaagaaggtggctagagcatggctggagggtgcaggggagccaaagggatttgggagagggaaagaggaaactttgtgggaacaggagagagctcaagatggcctgcagtggactctcttgccaggaggacacaaggggcccagggactggggggtctctcacaggccatctggtgcagtggttctggaatcctactgtgctgcctaggtaggaatctgcctccttacatgaggcctcttgctggtgcctctcttgtctgctttttcacctgcaaaatgaggataataatgatgcctgt

SEQ ID NO: 422949 - DNA, 2462 bp, Homo sapiens
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagcccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422950 - DNA, 3109 bp, Homo sapiens
  misc_feature (1323)..(1323): n is a, c, g, or t
  misc_feature (1379)..(1379): n is a, c, g, or t
  misc_feature (1415)..(1415): n is a, c, g, or t
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgactggtaagggggccaggcacactgtcatgctgaggcggntatcagggagaattggctgggactgcaataccaagcctcaggtggctaaggagggngcggggaaggatgggtggaatgagaggcatgggctntcctgcttaaaagaaggatctggtgcccttctctctcccttctcagcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422951 - DNA, 3159 bp, Homo sapiens
  misc_feature (1373)..(1373): n is a, c, g, or t
  misc_feature (1429)..(1429): n is a, c, g, or t
  misc_feature (1465)..(1465): n is a, c, g, or t
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggtaaaagcgaccctcagtttcccccagtcctgctcattttggtcacgcctctttgaagtcagctgtgcagaaacccgcgacggatgggcgccagacggggctctggaggctttggggagttgtagtctccggccatgcccttgaggatcttagattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgactggtaagggggccaggcacactgtcatgctgaggcggntatcagggagaattggctgggactgcaataccaagcctcaggtggctaaggagggngcggggaaggatgggtggaatgagaggcatgggctntcctgcttaaaagaaggatctggtgcccttctctctcccttctcagcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422952 - DNA, 3291 bp, Homo sapiens
  misc_feature (1505)..(1505): n is a, c, g, or t
  misc_feature (1561)..(1561): n is a, c, g, or t
  misc_feature (1597)..(1597): n is a, c, g, or t
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggtgagattctcaggagagggctttgccgtcccccagggttctttcaatccctgtatccccatccctatattctcccctaattggtacctttcaagatccttctatactgcctgccccctttcatgtttgctctccatttccctgtttctctctttttctgtcacctgcccttcgtccttcaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgactggtaagggggccaggcacactgtcatgctgaggcggntatcagggagaattggctgggactgcaataccaagcctcaggtggctaaggagggngcggggaaggatgggtggaatgagaggcatgggctntcctgcttaaaagaaggatctggtgcccttctctctcccttctcagcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422953 - DNA, 1911 bp, Homo sapiens
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaaaaaaaaaaaa

SEQ ID NO: 422954 - DNA, 747 bp, Homo sapiens
ttcatttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaaatcgcctggctgagggagctggtggctgaggattcagggattgttggcgttattcaaagaggagactttgaaattccccgatggctggaatgtggaagccccaggtgcctctggtggagggtcatctgcttttccagactgtgggttgtgaaccggctccttctccaagaaaggttgcagctgagaacatccagaggtgagactcagacacattgaaagtgactgcatttagggaggttaacgagttctta

SEQ ID NO: 422955 - DNA, 781 bp, Homo sapiens
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacaggtaaaggtggagatgtctttctttctcagcgtaggaaccaggagttctagttccatgggttaccagcatgcccttgagtaatcaatctgtctgttcctcatctgtaaaatggagaaaattatcagtgtcaagcttgagtgttgttaggagatttaacggaaatactaaatagaaagtgccaggcacattttaggtgtttggtgaacactggctgttgttgcttctcaagagttctatgctcctgccttttacctggagtcattagtgcaccacgtggcttttagataccctaccaataaaataatgttgacattgattgtattttctcattcacctttcccctgagcttctaataaacaaattataacagttttgta

SEQ ID NO: 422956 - DNA, 624 bp, Homo sapiens
ccaccgatgacctaatttcctaatttccattgcctaatgctcaacaggtgcttccagaacaatagtgtgagaagcaccgctgccttctgcccccaccttttgttttgagatcttggtaatgaaagtgtagctagttgcttattaatttcactcttaaatatttttcacattcacagatcgggtgctaccaaggttttgcttttgcatggaaatgtctactgcacagttgcaccactgagaaggacaggtaaaggtggagatgtctttctttctcagcgtaggaaccaggagttctagttccatgggttaccagcatgcccttgagtaatcaatctgtctgttcctcatctgtaaaatggagaaaattatcagtgtcaagcttgagtgttgttaggagatttaacggaaatactaaatagaaagtgccaggcacattttaggtgtttggtgaacactggctgttgttgcttctcaagagttctatgctcctgccttttacctggagtcattagtgcaccacgtggcttttagataccctaccaataaaataatgttgacattgattgtattttctcattcacctttcccctgagcttctaataaacaaattataacagttttgta

SEQ ID NO: 422957 - DNA, 529 bp, Homo sapiens
tgatttcgtgtaatgagaaaataatcatccagcttttgaacgaaggcattcttagcgcacctgctgggtttcaggaagccagcagcatagctgttgtgtaagttgagcctgttgtgtgcacatgactgagagtctgtatttctgtgctttacagcagaaagatgaaggtcttagaatcattgattggaatgatccagaaattcccttatgatgaccctacttacgataaactccatgaagattaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaagtt

SEQ ID NO: 422958 - DNA, 959 bp, Homo sapiens
tggggggggcacagatgagcagagtggatggttcggtgggtccccacgaggcgagtggtggtcatatgtgatggcacgtgttcacacaccctcctgtgtacccccccagggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaagtt

SEQ ID NO: 422959 - DNA, 1481 bp, Homo sapiens
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaagtt

SEQ ID NO: 422960 - DNA, 1349 bp, Homo sapiens
cctcgtgctgcgacagtgggggagctgtgagttgcctcctggctgacttccagtgcccggcccagaggacgcgtccatagatgttagttaagaaagcggccgaacatttagcagtcaggcgctgacgtttatttagctcgcgctgtgagtcagacactgagctaaacgttccaccctggttatctacttcagccctacttaatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaagtt

SEQ ID NO: 422961 - DNA, 1324 bp, Homo sapiens
ccaccgatgacctaatttcctaatttccattgcctaatgctcaacaggtgcttccagaacaatagtgtgagaagcaccgctgccttctgcccccaccttttgttttgagatcttggtaatgaaagtgtagctagttgcttattaatttcactcttaaatatttttcacattcacagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaagtt

SEQ ID NO: 422962 - DNA, 1484 bp, Homo sapiens
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctctccacacatgccctttgttgggctgaagccgtccctggcagagccctcgtgcattgacttgacagcctctccggcagcacaggcctagctggttctgggttggagttggctctggatagggttagtcaccaggcctggactgaaggcagttatttttattattattattatttgcaatgagagagatggttggccccgaatgaggctcatgggaggtttggacgggtgctgtgccgcatgtcgaggccgattgtgtgccaggcggtgcgggacgtgcctcccgtgtgttatttaatcccttcaggagcccacaagatgggtgttattctcattttacagaggagggaggggagacgcgaagggattgcctggtctaagggcacccagcagcagagctaggacttccgccctaaggctgtgcctcactgccaccaggcacagccgcctccggaatgcacaggcgagtccctgccctccctcccaggccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctctt

SEQ ID NO: 422963 - DNA, 745 bp, Homo sapiens
cctcgtgctgcgacagtgggggagctgtgagttgcctcctggctgacttccagtgcccggcccagaggacgcgtccatagatgttagttaagaaagcggccgaacatttagcagtcaggcgctgacgtttatttagctcgcgctgtgagtcagacactgagctaaacgttccaccctggttatctacttcagccctacttagtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaagtt

SEQ ID NO: 422964 - DNA, 916 bp, Homo sapiens
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctctt

SEQ ID NO: 422965 - DNA, 801 bp, Homo sapiens
cctcgtgctgcgacagtgggggagctgtgagttgcctcctggctgacttccagtgcccggcccagaggacgcgtccatagatgttagttaagaaagcggccgaacatttagcagtcaggcgctgacgtttatttagctcgcgctgtgagtcagacactgagctaaacgttccaccctggttatctacttcagccctacttagtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacaggtgcgtgcactgtgtgtttcctcctgctaggagcacctgattgcgcctttcccaggcggggcagcgcactcccggggccgctgcggcaatggcctggggctgcgtgcgccgcggaactgtccgtagaggcgcctcatccttgagtcgcagtgcaggaaaactgaagacagtccagagaaaaggagttagaactcatttatgggctggccacatagacaggaaaagctatagctagagatagagttatcttctcatttttcagtaaaaatgcacaagattaaaaataccatctcttttgtgttttc

SEQ ID NO: 422966 - DNA, 742 bp, Homo sapiens
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgaggtaagtgggaacccccatctggagatgaagcctcttcatttacaatttataatttatttcgatattcagtgtgatggagtaagaattgtcaggccttttaaaatcacagtgccggatgggcgcggtgactcacacctgtaatcccagcactttgggagtctgaggtgggtggatcgccttgaggtcaggagttggagaccagcctgaccaacatggtgaaaccctgtctctactaaaaatactgaattagctgggcatggtggtgcatgcctgtaatcccagccacttgggaggctgaggtatgagactcgcttgaacctgggaggcagaggttgtggtaagccgggaccgtgccattgcactgcagcctgggcgacaggatgaaactccatctccaaaaaataaacaa

SEQ ID NO: 422967 - DNA, 663 bp, Homo sapiens
ctcagcctggtggttcccctcctccgaggccgcctcgtcctctgggaggacagacctttgccatctgggagctgcctttttttctggttccttaatcataggacatacggcagtattcatggatgtgctgatagatgtacccgaccacaccccttttccctccagagcccctggggagcccctcgtgctgcgacagtgggggagctgtgagttgcctcctggctgacttccagtgcccggcccagaggacgcgtccatagatgttagttaagaaagcggccgaacatttagcagtcaggcgctgacgtttatttagctcgcgctgtgagtcagacactgagctaaacgttccaccctggttatctacttcagccctacttagtaagtggatcctattattcttcggaatttacagactaggaggcacagtcactttccagggtcacacaactattaagtggggagctatgcaccctgcttcatggggcgctgcagcccactccttgcatgtttggtgactgcaggttaagatagtggcagttccactgttgggcctcagggtcagtgctactccgggtaccagtcggagaacattttgtggtgatctgatgccatttctctctgttgccctacccatgtgatgtcaaaccctgtgtatgttgc

SEQ ID NO: 422968 - DNA, 1555 bp, Homo sapiens
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctctccacacatgccctttgttgggctgaagccgtccctggcagagccctcgtgcattgacttgacagcctctccggcagcacaggcctagctggttctgggttggagttggctctggatagggttagtcaccaggcctggactgaaggcagttatttttattattattattatttgcaatgagagagatggttggccccgaatgaggctcatgggaggtttggacgggtgctgtgccgcatgtcgaggccgattgtgtgccaggcggtgcgggacgtgcctcccgtgtgttatttaatcccttcaggagcccacaagatgggtgttattctcattttacagaggagggaggggagacgcgaagggattgcctggtctaagggcacccagcagcagagctaggacttccgccctaaggctgtgcctcactgccaccaggcacagccgcctccggaatgcacaggcgagtccctgccctccctcccaggccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctctt

SEQ ID NO: 422969 - DNA, 1455 bp, Homo sapiens
cctcgtgctgcgacagtgggggagctgtgagttgcctcctggctgacttccagtgcccggcccagaggacgcgtccatagatgttagttaagaaagcggccgaacatttagcagtcaggcgctgacgtttatttagctcgcgctgtgagtcagacactgagctaaacgttccaccctggttatctacttcagccctacttagtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaagtt

SEQ ID NO: 422970 - DNA, 1449 bp, Homo sapiens
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctctccacacatgccctttgttgggctgaagccgtccctggcagagccctcgtgcattgacttgacagcctctccggcagcacaggcctagctggttctgggttggagttggctctggatagggttagtcaccaggcctggactgaaggcagttatttttattattattattatttgcaatgagagagatggttggccccgaatgaggctcatgggaggtttggacgggtgctgtgccgcatgtcgaggccgattgtgtgccaggcggtgcgggacgtgcctcccgtgtgttatttaatcccttcaggagcccacaagatgggtgttattctcattttacagaggagggaggggagacgcgaagggattgcctggtctaagggcacccagcagcagagctaggacttccgccctaaggctgtgcctcactgccaccaggcacagccgcctccggaatgcacaggcgagtccctgccctccctcccaggccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctctt

SEQ ID NO: 422971 - DNA, 965 bp, Homo sapiens
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgcacagccgcctccggaatgcacaggcgagtccctgccctccctcccaggccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctctt

SEQ ID NO: 422972 - DNA, 750 bp, Homo sapiens
gaaagatgtagcaataattatatttgtgtttatgagttttttttattaacctctacacttgataatgaaagaggtttccactgctaaaggaaaataaatctcttgatgccaaaattactaagccactagaaaagtcaagttgagaactatgtcaggcaaatctgcctcccattttatttctaaataagatagctacaaagataaaaaagctacatactttctttacaattagccaacaaggaaattccttgagaaccaaagacagacagaactcagagtcatttctctgagcctcgcctgagacaaatgcacatctgattgcttcctctgcactgctgttaatttagatatgcaggttcactgagccagactaaattgtattcagttgaatgcttatcaaggactcaagaatccagacttttatctcttatttacttatgacctggaagccctcacctcaagttgtcctgcattactggatcaaaccaagaaagagagagaggaaggaggaggtggagaaggaaaaaggtagggaaggaagatcttatacatattgattgatgtctcatgctttcctaaaatgtttaaaagctgctgggcatggtggctcacacctgtaatcccagcactttgggaggctaaggcgagcagttcaccaggtcaggagacatcctggctaacagggtgaaaccctgtctctactaaaaatacaaaaaattagctggtattcatagaaaatataatttttaa

SEQ ID NO: 422973 - DNA, 856 bp, Homo sapiens
accttgtgacatatctgtgcatccattactttggaggtgtgactctcctcttccatctgcaccatgcccagagaaagattgtgttgcatctctgggttcagcaaccaggtgctgtgtttcttgtgcccaggccttgcctgcagagagaattgtgacatagctgggtccagtaccaagtaacgtgactttgttgtctgtgccttgctttcgagaaggaattgtaacataaccctggacaggcaaccagccctcacctcaagttgtcctgcattactggatcaaaccaagaaagagagagaggaaggaggaggtggagaaggaaaaagacctgaaagtgattcacagaccatggggcccagaaacccgatcaaagtaacgtgtgcattgagtagacatgaggacatgaggatctccactttcttcctcttgctaaaaatgccctaaactgtgtaggtgaaacctgctgccacaccaccagatttagctccactaaatctgcagccccaaattctgattctgggttttgagatttgagaaataaaaaaaaactttaatctgagaaatgcaagtccttttttcaaactcagagacattaaaatgagaacacaattatttctttctcctccctttgaactatgtatttatctcttgaaactatttgctattgccacaagtagctataaactaaactaataatgtcacactggacactataacccataccttaaaccttaacaatgtatatccaatcaataatcagtgttatttctgtaaataaataagacttcctgacaacttttttttttggttggttgggttgtttgatttttgagacagtttcactcttgttgcccag

SEQ ID NO: 422974 - DNA, 1311 bp, Homo sapiens
aaactgagcctgaatcactgctcaggcttagtgagcctgctgaactctctttctgtctttgcaatctcttaagcagatttactgtcatgctgctcacattctggtttaattgtgtaataaacaattttatttctgttctatcattttggagtttctctggggctgcagaaattttttttaaattccatttccaaacactgtcttgaattaccagacataatataaacacataaggtgccaactaacctttaatctagaggaaactttttctttcaggcttcccatctattcacaattgtgctgcaaagtgtatgatgtcccctaaatatgcaggtggaattgtttttttgcctatttggtatatgtaattaactgtagtcgcttctagaaaggatagacaaaatttctacaaacttcacagagaaggaaccaaccatttacctcttcatttattattttttatttttttgagatggagtcttgctctgttgcccaggctggagtgcagtggcaccatctcggcctactgcaacctctgcctctcgggtttaagcgattcttctgcctcagcctcccaagtagctgggactacaggtgagttccaccatgcccagctaatttttgtatttttagtagacgaagtttcaccatattggctggattggtcttgatctcttgacctcctgatccacctgccttggcctcccacagtgctgggattacaggcgtgagccactgacccaggctattttacctttttcaatgactcttgtatcctcagacctgaaagtgattcacagaccatggggcccagaaacccgatcaaagtaacgtgtgcattgagtagacatgaggacatgaggatctccactttcttcctcttgctaaaaatgccctaaactgtgtaggtgaaacctgctgccacaccaccagatttagctccactaaatctgcagccccaaattctgattctgggttttgagatttgagaaataaaaaaaaactttaatctgagaaatgcaagtccttttttcaaactcagagacattaaaatgagaacacaattatttctttctcctccctttgaactatgtatttatctcttgaaactatttgctattgccacaagtagctataaactaaactaataatgtcacactggacactataacccataccttaaaccttaacaatgtatatccaatcaataatcagtgttatttctgtaaataaataagacttcctgacaacttttttttttggttggttgggttgtttgatttttgagacagtttcactcttgttgcccag

SEQ ID NO: 422975 - DNA, 1067 bp, Homo sapiens
  misc_feature (14)..(14): n is a, c, g, or t
  misc_feature (19)..(19): n is a, c, g, or t
cccccccccccccnccaangtttttctttcaggcttcccatctattcacaattgtgctgcaaagtgtatgatgtcccctaaatatgcaggtggaattgtttttttgcctatttggtatatgtaattaactgtagtcgcttctagaaaggatagacaaaatttctacaaacttcacagagaaggaaccaaccatttacctcttcatttattattttttatttttttgagatggagtcttgctctgttgcccaggctggagtgcagtggcaccatctcggcctactgcaacctctgcctctcgggtttaagcgattcttctgcctcagcctcccaagtagctgggactacaggtgagttccaccatgcccagctaatttttgtatttttagtagacgaagtttcaccatattggctggattggtcttgatctcttgacctcctgatccacctgccttggcctcccacagtgctgggattacaggcgtgagccactgacccaggctattttacctttttcaatgactcttgtatcctcagacctgaaagtgattcacagaccatggggcccagaaacccgatcaaagtaacgtgtgcattgagtagacatgaggacatgaggatctccactttcttcctcttgctaaaaatgccctaaactgtgtaggtgaaacctgctgccacaccaccagatttagctccactaaatctgcagccccaaattctgattctgggttttgagatttgagaaataaaaaaaaactttaatctgagaaatgcaagtccttttttcaaactcagagacattaaaatgagaacacaattatttctttctcctccctttgaactatgtatttatctcttgaaactatttgctattgccacaagtagctataaactaaactaataatgtcacactggacactataacccataccttaaaccttaacaatgtatatccaatcaataatcagtgttatttctgtaaataaataagacttcctgacaacttttttttttggttggttgggttgtttgatttttgagacagtttcactcttgttgcccag

SEQ ID NO: 422976 - DNA, 592 bp, Homo sapiens
  misc_feature (14)..(14): n is a, c, g, or t
  misc_feature (19)..(19): n is a, c, g, or t
cccccccccccccnccaangtttttctttcaggcttcccatctattcacaattgtgctgcaaagtgtatgatgtcccctaaatatgcaggtggaattgtttttttgcctatttggtatatgtaattaactgtagtcgcttctagaaaggatagacaaaatttctacaaacttcacagagaaggaaccaaccatttacctcttcatttattattttttatttttttgagatggagtctgggcaacaagagcgaaactccatctcacgaaaaaaaaaaaaaaaaaaaaaaaggcctgattctttcttgcccggcttatcattgggcagtcagctctgggtcactggaatcctctcacaatcaactagacatctttgcgacatttgaaaatgtccagaacagaattgtgtcatgctgacaagaatggttaattctgctctgtctcagtctaggataaattagtcatgctgttcttgtttctcatcttgtgtaagatggtacccagatgagagtttttgcagttttcttgtagttgggtgaaaaacaggagatctggagactcaaacagataaactaatttctaccatttcttatg

SEQ ID NO: 422977 - DNA, 1139 bp, Homo sapiens
accttgtgacatatctgtgcatccattactttggaggtgtgactctcctcttccatctgcaccatgcccagagaaagattgtgttgcatctctgggttcagcaaccaggtgctgtgtttcttgtgcccaggccttgcctgcagagagaattgtgacatagctgggtccagtaccaagtaacgtgactttgttgtctgtgccttgctttcgagaaggaattgtaacataaccctggacaggcaaccaggtaatatgactctcctgcctggtccttgtcctgaaaaattgtgacatatttccgactcagcatgcaggtgatgttactctcccatttactttctactcacaggttagattgtgacatacactttagcccagttcacagttgcgatgatgatactcataccacaaaccagtccatagcagagatactggtgctggtagctagacttagagaaacaggtaaagtcctggattaccattctttcacattttgtataaagtctttggacggtacagagagtgttatcatagggccaagcacacaggtgagactgtttctcaaatgcacaacctaccaaatgttagcattgtcaccctcacacgaatttcacacgtgaatggagtccacagtaaaaattgtgactgtcatatgtaatcatgtgacaacagttaagatggtgactcatttctaaacctagctcataggcaggtgagaactcttttctctagacccagccaattggagagatgttgactctaatgcatgagcctaggtccacaggtatgattatgagtttgtattagaaaaaaaagtctcagagcaaattgtgaccatcatggatattgtataaagccctcaggtagtatagagagttctataacagggcctagcacccaggtgacattgtgacactcgtatgcaaacccagccaacagtgaaaattgacaactttccacatgaacacagctcactgttgaagttctgaatctcacacctggaggtggttggaaaattgactctcaaacgtggattcggttcacacgtgggctggtgactctcaaaccaagattcagcatacctgtgaggctgtgactccactaaggggacacagtccacggcaaagattgaggctctc

SEQ ID NO: 422978 - DNA, 2033 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422979 - DNA, 718 bp, Homo sapiens
gcttgcagtgagctgagatcgcgccactgcactccagcctgggcaacagagcgagactctgtctcagaaaaaaaaataaaaaataaaaaaattaaaacttagatgggcgtcttggcaggcatgatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtggacaactgctatgaacactctgagcccagttacccctggcggctacaagagtccggaactgaccgccagctgggcagtccgcgctgcaagcacacctgaagtgataactgtccacagcaaaggccccactataacgtccagcattatgcaagccccctccttaaccattgacgtaacgctcaa

SEQ ID NO: 422980 - DNA, 476 bp, Homo sapiens
aggtatcgtcttaatgaccctagcctccgtcgcatgagcagactttaggacaaccatccatgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgacccacacagtgcccgcctggagggcctgggacaggtaattggccttgtccaaatcctttgtgaagacagctgcggccagcccgtacgtggaattgttggctctcccaacaacctcctctatggtcttgaacttcaggatctgcatcactggcccgaagatctccttcttggcgatggtcatgccatcctgcacat

SEQ ID NO: 422981 - DNA, 2335 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaactgtagggaccagccccacagggtcggtgggtttttctccccatgtgcggagacgagagattgtagaaataaagacacaagacaaagaggtaaaagaaaagacagctgggcttgggggaccactaccaccaagaggcggagaccggtagaggccccgaatgtctggctgcactgttatttattggatacaaagcaaaaggggcagggtaaagagtgtgagtcatctccaatgacaggtaaggtcacgtgggtcacgtgtccactggacagggggcccttccctgcctggcagccaaggcaga

SEQ ID NO: 422982 - DNA, 2117 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccaggatccagattttcgatacaatcgagattgagatggctacgagtgccagtcatgctaggaaaatcattccccacctgtcaatcccgtccacctgcgagagagtcatcttgtcaggtatctagaatcgggacgcggaagatgtggacaaggcattgaacggtcgtccgtggccgctcttcctgagactggagctctacctttgtgacgccagctgttgtgacatcaattccacgagctagtggcggctcagtgcgttgcatgtaaccagtccatgtgtccgattcctgaatcagaggtcgaggcactcgggatccatatcgcatgtggcggggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422983 - DNA, 1806 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422984 - DNA, 2193 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtgctcatccttgaaggatgagaaactgtatcacaagaaacaaaccaaaaaataatgcttaacagcctagatgagatttcaaaccatacaccaaaactaaacagctcccattaaaacagctaggtgcattggctcacaaaatgctgtaatgccctagcattttgggaggccgatgagggaggatcccatgacccccaggaattcgagaccagcctaagcaacatagcagcattctcatacggggatcct

SEQ ID NO: 422985 - DNA, 1075 bp, Homo sapiens
  misc_feature (9)..(9): n is a, c, g, or t
aggtatctngctctgcctcgattctcagtctcatgtatgtatgcacttcgactcttagggacaccaaccatgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422986 - DNA, 1456 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttgatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422987 - DNA, 1976 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa

SEQ ID NO: 422988 - DNA, 1988 bp, Homo sapiens
cggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaa
